(12) United States Patent
Krishnan et al.

(10) Patent No.: US 11,685,787 B2
(45) Date of Patent: Jun. 27, 2023

(54) TREATMENT OF CANCER WITH ANTI-GITR AGONIST ANTIBODIES

(71) Applicant: BRISTOL-MYERS SQUIBB COMPANY, Princeton, NJ (US)

(72) Inventors: Suba Krishnan, New York, NY (US); Penny E. Phillips, Morristown, NJ (US); Zheng Yang, Plainsboro, NJ (US); Haiqing Wang, Princeton, NJ (US)

(73) Assignee: Bristol-Myers Squibb Company, Princeton, NJ (US)

( * ) Notice: Subject to any disclaimer, the term of this patent is extended or adjusted under 35 U.S.C. 154(b) by 463 days.

(21) Appl. No.: 16/612,956

(22) PCT Filed: May 15, 2018

(86) PCT No.: PCT/US2018/032750
§ 371 (c)(1),
(2) Date: Nov. 12, 2019

(87) PCT Pub. No.: WO2018/213297
PCT Pub. Date: Nov. 22, 2018

(65) Prior Publication Data
US 2020/0291122 A1   Sep. 17, 2020

Related U.S. Application Data

(60) Provisional application No. 62/573,494, filed on Oct. 17, 2017, provisional application No. 62/514,312, filed on Jun. 2, 2017, provisional application No. 62/514,245, filed on Jun. 2, 2017, provisional application No. 62/507,071, filed on May 16, 2017.

(51) Int. Cl.
| | | |
|---|---|---|
| A61P 35/00 | (2006.01) | |
| C07K 16/28 | (2006.01) | |
| A61K 39/00 | (2006.01) | |

(52) U.S. Cl.
CPC .......... *C07K 16/2878* (2013.01); *A61P 35/00* (2018.01); *C07K 16/2818* (2013.01); *C07K 16/2827* (2013.01); *A61K 2039/507* (2013.01); *A61K 2039/545* (2013.01); *C07K 2317/75* (2013.01); *C07K 2317/76* (2013.01)

(58) Field of Classification Search
CPC .................................................. C07K 16/2878
USPC ....................................................... 424/143.1
See application file for complete search history.

(56) References Cited

U.S. PATENT DOCUMENTS

| | | |
|---|---|---|
| 5,624,821 A | 4/1997 | Winter et al. |
| 5,648,260 A | 7/1997 | Winter et al. |
| 6,111,090 A | 8/2000 | Gorman et al. |
| 6,509,173 B1 | 1/2003 | Ni et al. |
| 7,025,962 B1 | 4/2006 | Gorman et al. |
| 7,247,302 B1 | 7/2007 | Rosok et al. |
| 7,521,051 B2 | 4/2009 | Collins et al. |
| 7,812,135 B2 | 10/2010 | Smith et al. |
| 8,008,449 B2 | 8/2011 | Korman et al. |
| 8,354,509 B2 | 1/2013 | Carven et al. |
| 8,383,796 B2 | 2/2013 | Korman et al. |
| 8,709,424 B2 | 4/2014 | Schebye et al. |
| 9,228,016 B2 | 1/2016 | Wang et al. |
| 9,745,379 B2 | 8/2017 | Wang et al. |
| 10,465,010 B2 | 11/2019 | Wang et al. |
| 10,501,550 B2 | 12/2019 | Wang et al. |
| 10,690,674 B2 | 6/2020 | Wang et al. |
| 11,084,881 B2 | 8/2021 | Wang et al. |
| 11,213,586 B2 | 1/2022 | Wang et al. |
| 2002/0081597 A1 | 6/2002 | Lowe et al. |
| 2006/0099171 A1 | 5/2006 | Tone et al. |
| 2006/0281146 A1 | 12/2006 | Bodary et al. |
| 2006/0286112 A1 | 12/2006 | Kellermann et al. |
| 2007/0037148 A1 | 2/2007 | Fong et al. |
| 2007/0048301 A1 | 3/2007 | Bodary-Winter et al. |
| 2007/0098719 A1* | 5/2007 | Smith ................ C07K 16/2878 435/325 |
| 2007/0185017 A1 | 8/2007 | Aggarwal et al. |
| 2012/0328616 A1 | 12/2012 | Li et al. |
| 2014/0065152 A1 | 3/2014 | Kwon |
| 2015/0064204 A1 | 3/2015 | Beers et al. |
| 2015/0073043 A1 | 3/2015 | Li et al. |
| 2015/0353637 A1 | 12/2015 | Wang et al. |
| 2016/0145342 A1 | 5/2016 | Wang et al. |
| 2017/0145104 A1 | 5/2017 | Wang et al. |
| 2018/0002432 A1 | 1/2018 | Wang et al. |
| 2018/0164321 A1 | 6/2018 | Wang et al. |
| 2018/0339042 A1 | 11/2018 | Wang et al. |

(Continued)

FOREIGN PATENT DOCUMENTS

| | | |
|---|---|---|
| CN | 105793287 A | 7/2016 |
| EP | 0920505 B1 | 6/2008 |

(Continued)

OTHER PUBLICATIONS

Tockman et al (Cancer Res., 1992, 52:2711s-2718s).*
Ferrandina et al (BMC Cancer, 2006, 6(182): 1-5).*
Kuenen et al (Clin Cancer Res, 2010, 16(6): 1915-1923).*
Tietz et al (European Journal of Cancer, 2017, 75: 268-279).*
Hamanishi et al (Journal of Clinical Oncology, 2014, 32(15: Abstract 5511).*
Chu et al (Blood, 2012, 120(21): Abstract 162).*
Felix et al (Oncoimmunology, 2016, 5(7): e1136045; 10 pages).*
Rawal et al (Blood, 2012, 120(21): Abstract 2766).*
Reichert, J., "Monoclonal antibodies in the clinic," Nat. Biotech, vol. 19, 819-822 (2001).

(Continued)

*Primary Examiner* — Sean E Aeder
(74) *Attorney, Agent, or Firm* — Nelson Mullins Riley & Scarborough LLP; Jane E. Remillard, Esq.; Christopher L. Frank

(57) ABSTRACT

Provided herein are methods for treating cancer, comprising administering to a subject having cancer a therapeutically effective amount of an anti-GITR antibody alone or together with an anti-PD-1 or anti-PD-L1 antibody.

19 Claims, 17 Drawing Sheets
Specification includes a Sequence Listing.

(56) References Cited

U.S. PATENT DOCUMENTS

| | | | |
|---|---|---|---|
| 2019/0160179 A1* | 5/2019 | Neville | C07K 16/2809 |
| 2020/0079865 A1 | 3/2020 | Wang et al. | |
| 2020/0115463 A1 | 4/2020 | Wang et al. | |
| 2020/0291122 A1 | 9/2020 | Krishnan et al. | |
| 2021/0011022 A1 | 1/2021 | Wang et al. | |
| 2022/0175921 A1 | 6/2022 | Wang et al. | |

FOREIGN PATENT DOCUMENTS

| | | |
|---|---|---|
| EP | 2343320 A1 | 7/2011 |
| EP | 2481752 A1 | 8/2012 |
| EP | 3151921 A2 | 4/2017 |
| JP | 2008 278814 A | 11/2008 |
| KR | 20080105674 A | 12/2008 |
| WO | 98/06842 A1 | 2/1998 |
| WO | 98/24895 A1 | 6/1998 |
| WO | 99/20758 A1 | 4/1999 |
| WO | 99/25834 A1 | 5/1999 |
| WO | 99/40196 A1 | 8/1999 |
| WO | 00/05374 A2 | 2/2000 |
| WO | 00/32221 A2 | 6/2000 |
| WO | 00/32778 A2 | 6/2000 |
| WO | 00/50459 A1 | 8/2000 |
| WO | 2001003720 A2 | 1/2001 |
| WO | 2001/46232 A2 | 6/2001 |
| WO | 2001/46261 A1 | 6/2001 |
| WO | 2001040464 A1 | 6/2001 |
| WO | 2001/90304 A2 | 11/2001 |
| WO | 2002/22153 A2 | 3/2002 |
| WO | 2002/072607 A2 | 9/2002 |
| WO | 2003/006058 A1 | 1/2003 |
| WO | 2003068257 A1 | 8/2003 |
| WO | 03/099196 A2 | 12/2003 |
| WO | 2004107618 A2 | 12/2004 |
| WO | 2005/007190 A1 | 1/2005 |
| WO | 2005/007699 A2 | 1/2005 |
| WO | 2005/016962 A2 | 2/2005 |
| WO | 2005/019258 A2 | 3/2005 |
| WO | 2005/052000 A2 | 6/2005 |
| WO | 2005/052001 A2 | 6/2005 |
| WO | 2005/100402 A1 | 10/2005 |
| WO | 2006050172 A2 | 5/2006 |
| WO | 2006078911 A2 | 7/2006 |
| WO | 2006/105021 A2 | 10/2006 |
| WO | 2006/124269 A2 | 11/2006 |
| WO | 2006/132272 A1 | 12/2006 |
| WO | 2007/002223 A2 | 1/2007 |
| WO | 2007120368 A2 | 10/2007 |
| WO | 2007/133822 A1 | 11/2007 |
| WO | 2008/070593 A2 | 6/2008 |
| WO | 2008/156712 A1 | 12/2008 |
| WO | 2009/009116 A2 | 1/2009 |
| WO | 2009/014708 A2 | 1/2009 |
| WO | 2009/100309 A2 | 8/2009 |
| WO | 2009/114335 A2 | 9/2009 |
| WO | 2009/120922 A2 | 10/2009 |
| WO | 2010/077634 A1 | 7/2010 |
| WO | 2011/028683 A1 | 3/2011 |
| WO | 2011109789 A2 | 9/2011 |
| WO | 2011/120134 A1 | 10/2011 |
| WO | 2011/161699 A2 | 12/2011 |
| WO | 2012/016227 A2 | 2/2012 |
| WO | 2012087928 A2 | 6/2012 |
| WO | 2012/098113 A1 | 7/2012 |
| WO | 2013/019906 A2 | 2/2013 |
| WO | 2013/039954 A1 | 3/2013 |
| WO | 2013/043569 A1 | 3/2013 |
| WO | 2013/119202 A1 | 8/2013 |
| WO | 2013/177101 A2 | 11/2013 |
| WO | 2014/089113 A1 | 6/2014 |
| WO | 2015026684 A1 | 2/2015 |
| WO | 2015/031667 A2 | 3/2015 |
| WO | 2015112900 A1 | 7/2015 |
| WO | 2015/184099 A1 | 12/2015 |
| WO | 2015/187835 A2 | 12/2015 |
| WO | 2016054638 A1 | 4/2016 |
| WO | 2016/081746 A2 | 5/2016 |
| WO | 2016/168716 A1 | 10/2016 |
| WO | 2016196792 A1 | 12/2016 |
| WO | 2018213297 A1 | 11/2018 |

OTHER PUBLICATIONS

Ronchetti et al., "GITR, a member of the TNF receptor superfamily, is costimulatory to mouse T lymphocyte subpopulations," Eur J Immunol, vol. 34, 613-622 (2004).

Rosenzweig et al., "Development of TRX518, an aglycosyl humanized monoclonal antibody (Mab) agonist of huGITR.," ASCO Meeting Library 2010 Annual Meeting, 1-2.

Rudikoff, S. et al., "Single amino acid substitution altering antigen-binding specificity," PNAS, vol. 79: 1979-1983 (1982).

Schaer et al., "Anti-GITR antibodies—Potential Clinical applications for tumor immunotherapy," Curr Opin in Investigational Drugs, vol. 11 (12), 1378-1386 (2010).

Schaer, et al. "Modulation of GITR for cancer immunotherapy," Curr Opin in Immunol, vol. 24, 217-224 (2012).

Schimizu et al., "Stimulation of CD25+CD4+ regulatory T cells through GITR breaks immunological self-tolerance," Nature Immunol, vol. 3 (2), 135-142 (2002).

Turk, et al., "Concomitant Tumor Immunity to a Poorly Immunogenic Melanoma Is Prevented by Regulatory T Cells," Journal of Exp Medicine, vol. 200 (6) 771-782 (2004).

U.S. Appl. No. 60/665,322, filed Mar. 25, 2005, 62 pages.

U.S. Appl. No. 60/687,265, filed Jun. 3, 2005, 71 pages.

Website Information for Monoclonal Anti-human GITR/TNFRSF 18 MAb (Clone 110416), Catalog No. MAB689, 1-2, Sep. 21, 2004.

White, A. et al., "Conformation of the Human Immunoglobulin G2 Hinge Imparts Superagonistic Properties to Immunostimulatory Anticancer Antibodies," Cancer Cell, vol. 27(1):138-148 (2015).

Whiteside, S. et al., "IkB proteins: structure, function and regulation," Seminars in Cancer Biology, vol. 8, 75-82 (1997).

Yang, W. et al., "CDR Walking Mutagenesis for the Affinity Maturation of a Potent Human Anti-HIV-1 Antibody into the Picomolar Range," J. Mol. Biol., vol. 254 (3): 392-403 (1995).

An Investigational Immuno-therapy Study of Experimental Medication BMS-986156, Given by Itself or in Combination With Nivolumab in Patients With Solid Cancers or Cancers That Have Spread, NIH U.S. National Library of Medicine ClinicalTrails.gov, Nov. 6, 2015 Retrieved from the Internet: URL:https://clinicaltrials.gov/ct2/show/NCT02598960 [retrieved on Aug. 10, 2018].

International Preliminary Report on Patentability, PCT/US2018/032750, dated Nov. 19, 2019, 14 pages.

International Search Report and Written Opinion, PCT/US2018/032750, dated Oct. 31, 2018, 24 pages.

Invitation to Pay Additional Fees and, Where Applicable, Protest Fee, PCT/US2018/032750, dated Aug. 24, 2018, 21 pages.

Khalil D. et al., "The New Era of Cancer Immunotherapy: Manipulating T-Cell Activity to Overcome Malignancy," Immunotherapy of Cancer in: Advances in Cancer Research, vol. 128, 1-68 (2015).

Khalil, D. et al., "The future of cancer treatment: immunomodulation," CARs and combination immunotherapy, Nature Reviews Clinical Oncology, vol. 13(5): 15 pages, 273-290(2016).

Kim E. et al., "Immune Checkpoint Modulators: An Emerging Antiglioma Armamentarium," Journal of Immunology Research, (2016).

Knee D. et al., "Rationale for anti-GITR cancer immunotherapy," European Journal of Cancer, vol. 67: 10 pages (2016).

Lohmueller J. et al., "Current modalities in cancer immunotherapy: Immunomodulatory antibodies, CARs and Vaccines," Pharmacology and Therapeutics, vol. 178: 31-47 (2017).

Lu, L. et al., "Combined PD-1 blockade and GITR triggering induce a potent antitumor im-munity in murine cancer models and synergizes with chemotherapeutic drugs," Journal of Translational Medicine, Biomed Central, vol. 12(1): 11 pages (2014).

NIH U.S. National Library of Medicine: "Phase 1/2 Study Exploring the Safety, Tolerability, and Efficacy of INCAGN01876 Combined With Immune Therapies in Advanced or Metastat-ic Malig-

(56) References Cited

OTHER PUBLICATIONS nancies," ClinincalTrials.gov, (2017) Retrieved from the Internet: URL:https://clinicaltrials.gov/ct2/show/NCTO3126110 [retrieved on Aug. 9, 2018].
Santoni, M. et al., "Triple negative breast cancer: Key role of Tumor-Associated Macrophages in regulating the activity of anti-PD-1/PD-L1 agents," BBA—Reviews on Cancer, vol. 1869(1):78-84 (2017).
Sharma P. et al., "Primary, Adaptive, and Acquired Resistance to Cancer Immunotherapy," Cell, Cell Press, vol. 168 (4):707-723 (2017).
Tan, W-L., et al., "Novel therapeutic targets on the horizon for lung cancer," The Lancet Oncology, vol. 17(8): e347:16 pages (2016).
Yu, N. et al., "Synergistic antitumor responses by combined GITR activation and sunitinib in metastatic renal cell carcinoma," International Journal of Cancer, vol. 138(2): 451-462 (2015).
Arnett, S. et al., "IBC's 21st Annual Antibody Engineering and 8th Annual Antibody Therapeutics International Conferences and 2010 Annual Meeting of the Antibody Society," Dec. 5-9, 2010, San Diego, CA USA, mAbs, vol. 3(2), Mar./Apr. 2011, 133-152.
Avogadri, F. et al., "Modulation of CTLA-4 and GITR for Cancer Immunotherapy," Curr Top Microbiol Immunol, vol. 344: 211-244 (2011).
Baecher-Allan, B. et al., "Inhibition of Human CD4+CD25+ high Regulatory T Cell Function," J. Immunol., vol. 169, 6210-6217 (2002).
Balint, R. et al., "Antibody Engineering by Parsimonious Mutagenesis," Gene, vol. 137: 109-118 (1993).
Baltz, K. et al., "Cancer immunoediting by GITR (glucocorticoidinduced TNF-related protein) ligand in humans: NK cell/tumor cell interactions," The FASEB Journal, Research Communication, vol. 21(8): 2442-2454 (2007).
Barrios, Y. et al., "Length of the antibody heavy chain complementarity determining region 3 as a specificity determining factor," J Molecular Recognition, vol. 17: 332-338 (2004).
Birebent, B. et al., "Suppressive properties of human CD4+CD25+ regulatory T cells are dependent on CTLA-4 expression," Eur. J. Immunol., vol. 34:3485-3496 (2004).
Bulliard, et al., "Activating Fc γ receptors contribute to the antitumor activities of immunoregulatory receptor-targeting antibodies," JEM, vol. 210 (9): 1685-1693 (2013).
Carter et al., "Humanization of an anti-p185HER2 antibody for human cancer therapy," PNAS, vol. 89, 4285-4289 (1992).
Chang, W. et al., "Clinical significance of regulatory T cells and CD8+ effector populations in patients with human endometrial carcinoma," Cancer, vol. 116 (24): 5777-5788 (2010).
Coe, D. et al., "Depletion of regulatory T cells by anti-GITR mAb as a novel mechanism for cancer immunotherapy," Cancer Immunol Immunother, vol. 59, 1367-1377 (2010).
Cohen et al., "Agonist Anti-GITR Monoclonal Antibody Induces Melanoma Tumor Immunity in Mice by Altering Regulatory T Cell Stability and Intra-Tumor Accumulation," PLoS, vol. 5, Iss. 5, 1-12 (2010).
Cohen et al., "Synergistic Tumor Immunity Induced by Chemotherapy and Agonist Anti-GITR Antibody," Blood, ASH Annual Meeting Abstracts, Dec. 8-11, 2007, vol. 110(11), 1788.
Cohen, et al., "Agonist Anti-GITR Antibody Enhances Vaccine-Induced CD8+ T-Cell Responses and Tumor Immunity," Cancer Res., vol. 66: (9):4904-4912 (2006).
Davies et al.," Affinity improvement of single antibody VH domains: residues in all three hypervanable regions affect antigen bnding," Immunotechnology, vol. 2, 169-179 (1996).
Dittmer et al., "Functional impairment of CD8+ T celIls by regulatory T cells during persistent retroviral infection," Immunity, vol. 20, 293-303 (2004).
Gasparoto, T. et al., "Patients with oral squamous cell carcinoma are characterized by increased frequency of suppressive regulatory T cells in the blood and tumor microenvironment," Cancer Immunology, Immunotherapy, vol. 59: 819-828 (2010).
Glaus et al., "In vivo SPECT/CT imaging of an anti-GITR antibody: A novel cancer immunotherapeutic," J Nucl Med., vol. 54 (Supplement 2):327 (2013).
Godrey et al., "Cord blood CD4+ CD25+-derived T regulatory cell lines express FoxP3 protein and manifest potent suppressor function," Blood, vol. 105 No 2, 750-758 (2005).
Gross et al., "TACI-Ig Neutralizes Molecules Critical for B Cell Development and Autoimmune Disease: Impaired B Cell Maturation in Mice Lacking BLyS," Immunity, vol. 15:289-302 (2001).
Gurney et al., "Identification of a new member of the tumor necrosis factor family and its receptor, a human ortholog of mouse GITR," Current Biology, vol. 9 (4), 215-218 (1999).
Hawkins, R.E. et al., "Selection of Phage Antibodies by Binding Affinity Mimicking Affinity Maturation," J. Mol. Biol., vol. 226(3): 889-896 (1992).
Hiroyoshi Nishikawa, "Application of Modulators of Cancer Immunosuppression for Immunotherapy—GITR and CTLA-4," The Medical Frontline, vol. 64 (11): 100-105 (2009).
Holt, L. et al., "Domain antibodies: proteins for therapy," Trends in Biotechnology, vol. 21 (11): 484-490 (2003).
Houot et al., "T-cell modulation combined with intratumoral CpG cures lymphoma in a mouse model without the need or chemotherapy," Blood, vol. 113 (15):3546-3552 (2009).
International Preliminary Report on Patentability, PCT/US2015/033991, dated Dec. 6, 2016, 11 pages.
International Search Report and Written Opinion, PCT/US2015/033991, dated Dec. 8, 2015, 17 pages.
Kanamaru et al., "Costimulation via Glucocorticoid-Induced TNF Receptor in Both Conventional and CD25+ Regulatory CD4+ T Cells," The Journal of Immunology, 7306-7314 (2004).
Kim et al., "Fcy receptors enable anticancer action of proapoptotic and immune-modulatory antibodies," J Exp Med., vol. 210 (9) 1647-1651 (2013).
Ko et al., "A Combination of Chemoimmunotherapies Can Efficiently Break Self-Tolerance and Induce Antitumor Immunity in a Tolerogenic Murine Tumor Model," Cancer Research, vol. 67 (15) 7477-7486 (2007).
Ko et al., "Treatment of advanced tumors with agonistic anti-GITR mAb and its effects on tumor-infiltrating Foxp3+ CD25+ CD4+ regulatory T cells," JEM, vol. 202 (7), 885-891 (2005).
Kwon et al., "Identification of a Novel Activation-inducible Protein of the Tumor Necrosis Factor Receptor Superfamily and Its Ligand," Journal of Biol Chem, vol. 274 (10) 6056-6061 (1999).
Little et al., "Of Mice and Men: hybridoma and recombinant antibodies," Immunology Today, vol. 21(8): 364-370 (2000).
Lu et al. "Combined PD-1 blockade and GITR triggering induce a potent antitumor immunity in murine cancer models and synergizes with chemotherapeutic drugs," Journal of Translational Medicine, vol. 12 (36), 1-11 (2014).
Marks, J. et al, "By-Passing Immunization: Building High Affinity Human Antibodies by Chain Shuffling," Biotechnology, vol. 10(7): 779-783 (1992).
McHugh et al., "CD4+CD25+ Immunoregulatory T Cells: Gene Expression Analysis Reveals a Functional Role for the Glucocorticoid-Induced TNF Receptor," Immunity, vol. 16, 311-323 (2002).
Melero et al., "Agonist Antibodies to TNFR Molecules That Costimulate T and NK Cells," Clinical Cancer Research, vol. 19 (5): 1044-1053, 1913 (2013).
Melero et al., "Clinical Development of Immunostimulatory Monoclonal Antibodies and Opportunities for Combination," Clinical Cancer Research, vol. 19(5), 997-1008 (2013).
Melero, I., "Immunological targets: Basic aspects," IL29, Annals of Oncology, vol. 22 (Supplement 3), 1 page, (2011) doi:10.1093/annonc/mdr103.
Mitsui et al, "Two Distinct Mechanisms of Augmented Antitumor Activity by Modulation of Immunostimulatory/Inhibitory Signals," Clinical Cancer Res, vol. 16, 2781-2791(2010).
National Cancer Institute, Immunotherapy Agent workshop Jul. 12, 2007, 1-77.
Nocentini et al., "A new member of the tumor necrosis factor/nerve growth factor receptor family inhibits T cell receptor-induced apoptosis," PNAS, vol. 94, 6216-6221 (1997).

(56) References Cited

OTHER PUBLICATIONS

Nocentini et al., "GITR: a multifaceted regulator of immunity belonging to the tumor necrosis factor receptor superfamily," Eur J of Immunol, vol. 35 Iss 4, 1016-1022 (2005).
Nocentini et al., "Identification of three novel mRNA splice variants of GITR," Cell Death and Differentiation, vol. 7, 408-410 (2000).
Padovani, C. et al., "Glucocorticoid-induced tumor necrosis factor receptor expression in patients with cervical human papillomavirus infection," Revista DA Sociedada Brasileira De Medicina Tropical, vol. 46(3):288-292 :(2013).
Patel, M. et al., "Agonist anti-GITR monoclonal antibody and stereotactic radiation induce immune-mediated survival advantage in murine intracranial glioma," Journal for ImmunoTherapy of Cancer, vol. 4(28)13 pages (2016).
Piatesi, A. et al., "Immunological Optimization of a Generic Hydrophobic Pocket for High Affinity Hapten Binding and Diets-Alder Activity," ChemBio Chem., vol. 5: 460-466 (2004).
Ponte et al., "Enhancement of humoral and cellular immunity with an antiglucocorticoid-induced tumour necrosis factor receptor monoclonal antibody," Immunology, vol. 130, 231-242 (2010).
Printout from the R&D Systems website showing a list of available anti-GITR antibodies, Jul. 2, 2014, 1-2.
Page 39 of the 1988 Stratagene Catalog.
Shimizu, J. et al., "Stimulation of CD25(+)CD4(+) regulatory T cells through GITR breaks immunological self-tolerance," Nature Immunology, vol. 3(2): 135-142 (2002).
WHO Drug Information. vol. 27, No. 2, 76 pages (2013).
WHO Drug Information. vol. 27, No. 1, 40 pages (2013).
U.S. Appl. No. 16/663,583, filed Oct. 25, 2019, Changyu Wang.
U.S. Appl. No. 16/578,987, filed Sep. 23, 2019, Changyu Wang.
U.S. Appl. No. 15/646,558, filed Jul. 11, 2017, Changyu Wang.
U.S. Appl. No. 15/369,290, filed Dec. 5, 2016, Changyu Wang.
U.S. Appl. No. 14/949,424, filed Nov. 23, 2015, Changyu Wang.
U.S. Appl. No. 14/732,082, filed Jun. 5, 2015, Changyu Wang.
U.S. Appl. No. 16/793,737, filed Jun. 10, 2020, Suba Krishnan.
U.S. Appl. No. 16/133,418, filed Sep. 17, 2018, Suba Krishnan.
U.S. Appl. No. 15/264,266, filed Sep. 13, 2016, Suba Krishnan.
U.S. Appl. No. 15/776,591, filed May 16, 2018, Changyu Wang.
U.S. Appl. No. 16/578,987, Oct. 16, 2020, M. Pak.
U.S. Appl. No. 16/578,987, Apr. 27, 2020, S. Shafer.
U.S. Appl. No. 15/646,558, Jun. 21, 2019, S. Shafer.
U.S. Appl. No. 15/646,558, Feb. 4, 2019, S. Shafer.
U.S. Appl. No. 15/646,558, Sep. 26, 2018, S. Shafer.
U.S. Appl. No. 15/646,558, May 30, 2018, S. Shafer.
U.S. Appl. No. 15/369,290, Oct. 24, 2019, J. Roark.
U.S. Appl. No. 15/369,290, Jul. 25, 2019, J. Roark.
U.S. Appl. No. 15/369,290, Nov. 8, 2018, J. Roark.
U.S. Appl. No. 15/369,290, Jul. 16, 2018, J. Roark.
U.S. Appl. No. 15/369,290, Feb. 8, 2018, J. Roark.
U.S. Appl. No. 14/949,424, Apr. 20, 2017, S. Shafer.
U.S. Appl. No. 14/949,424, Apr. 13, 2017, S. Shafer.
U.S. Appl. No. 14/949,424, Jan. 25, 2017, S. Shafer.
U.S. Appl. No. 14/949,424, Nov. 4, 2016, S. Shafer.
U.S. Appl. No. 14/723,082, Aug. 24, 2015, S. Shafer.
U.S. Appl. No. 14/732,082, Jul. 13, 2015, S. Shafer.
U.S. Appl. No. 15/776,591, Sep. 29, 2020, M. Pak.
U.S. Appl. No. 15/776,591, Jan. 29, 2020, S. Shafer.
U.S. Appl. No. 15/776,591, Nov. 4, 2019, S. Shafer.
Brahmner, J. et al., "Phase I study of single-agent anti-programmed death-1 (MDX-1106) in refractory solid tumors: safety, clinical activity, pharmacodynamics, and immunologic correlates," Journal of Clinical Oncology, vol. 28(19): 3167-3175 (2010).
Press Release, Tolerx Presents Preclinical Data on Novel T-cell Modulator, TRX518, for Antitumor Immune Response at Federation of Clinical Immunology Societies Scientific Meeting, Cambridge, MA, Jun. 25, 2015, PR Newswire, 1-3.
Safety Study of AMG 228 to Treat Solid Tumors, ClinicalTrials.gov Identifier: NCT02437916, date first posted: May 8, 2015, date last updated: Feb. 6, 2017,date retrieved: Feb. 14, 2018, 7 pages, <https://clinicaltrials.gov/show/NCT02437916>.
Siu, L. et al., "Preliminary results of a phase I/IIa study of BMS-986156 (glucocorticoid-induced tumor necrosis factor receptor-related gene [GITR] agonist), alone and in combination with nivolumab in pts with advanced solid tumors," Journal of Clinical Oncology, vol. 35 (15):Supp. 104: (May 2017) 4 page, retrieved date: Feb. 14, 2018, <http://ascopubs.org/doi/abs/10.1200/JCO.2017.35.15_suppl.104>.
Siu, L. et al., Preliminary Results of a Phase 1/2a Study of BMS-986156 (glucocorticoid-induced tumor necrosis factor receptor-related gene [GITR] agonist) Alone and in Combination With Nivolumab in Patients With Advanced Solid Tumors, slides presented at the ASCO Annual Meeting 2017, Jun. 2, 2017, 18 pages.
Study of MK-1248 With and Without Pembrolizumab (MK-3475) for Participants With Advanced Solid Tumors (MK-1248-001), ClinicalTrials.gov Identifier: NCT02553499, date first posted: Sep. 17, 2015 date last updated: Feb. 2, 2018, date retrieved: Feb. 14, 2018, 6 pages <https://clinicaltrials.gov/show/NCT02553499>.
Study of MK-4166 and MK-4166 in Combination With Pembrolizumab (MK-3475) in Participants With Advanced Solid Tumors (MK-4166-001), ClinicalTrials.gov Identifier: NCT02132754, date first posted: May 7, 2014, date last updated: Jan. 25, 2018, date retrieved: Feb. 14, 2018, 7 pages <https://clinicaltrials.gov/ct2/show/NCT02132754?term=mk4166&rank=1>.
Wang, H. et al., "Integration of Nonclinical PK/PD Data for First-in-Human Starting Dose Selection of Cancer Immune therapeutics," presented on Oct. 18, 2017 at 2017 (ISoP) International Society of Pharmacometrics—8th American Conference on Pharmacometrics (ACoP 8), 17 pages.
U.S. Appl. No. 17/883,896, filed Aug. 9, 2022, Suba Krishnan.
Jain A, et al., "Immunotherapy for nasopharyngeal cancer-a review," Chin Clin Oncol., vol. 5(2): 10 pages (2016).
Saraggi D, et al., "PD-L1 overexpression in ampulla of Vater carcinoma and its pre-invasive lesions," Histopathology, vol. 71(3):470-474 (2017).

\* cited by examiner

TREATMENT OF CANCER WITH ANTI-GITR AGONIST ANTIBODIES

CROSS-REFERENCE TO RELATED APPLICATIONS

This application is a 35 U.S.C. 371 national stage filing of International Application No. PCT/US2018/032750, filed on May 15, 2018, which claims priority to U.S. Provisional Application Nos. 62/507,071, filed on May 16, 2017; 62/514,245, filed on Jun. 2, 2017; 62/514,312, filed on Jun. 2, 2017; and 62/573,494, filed on Oct. 17, 2017, respectively. The contents of the aforementioned applications are hereby incorporated by reference.

SEQUENCE LISTING

The instant application contains a Sequence Listing which has been submitted electronically in ASCII format and is hereby incorporated by reference in its entirety. Said ASCII copy, created on Nov. 12, 2019, is named MXI_559US_Sequence_Listing.txt and is 651,606 bytes in size.

BACKGROUND

The National Cancer Institute has estimated that in the United States alone, 1 in 3 people will be struck with cancer during their lifetime. Moreover, approximately 50% to 60% of people contracting cancer will eventually succumb to the disease. The widespread occurrence of this disease underscores the need for improved anticancer regimens for the treatment of malignancy.

Recently, several immune checkpoint pathway inhibitors have begun to provide new immunotherapeutic approaches for treating cancer, including the development of an antibody (Ab), ipilimumab (YERVOY®), that binds to and inhibits Cytotoxic T-Lymphocyte Antigen-4 (CTLA-4) for the treatment of patients with advanced melanoma and the development of Abs such as nivolumab and pembrolizumab (formerly lambrolizumab; USAN Council Statement, 2013) that bind specifically to the Programmed Death-1 (PD-1) receptor and block the inhibitory PD-1/PD-1 ligand pathway.

SUMMARY

Provided herein are methods of treatment of a subject having cancer, e.g., advanced solid tumors, by administering an anti-GITR agonist Ab in combination with an anti-PD-1 or anti-PD-L1 Ab.

BRIEF DESCRIPTION OF DRAWINGS

FIG. 14 is a graph showing the percentage of Ki67-positive cells among CD8+ T cells at day 12 after cell implantation at the indicated doses of DTAmIgG2a.

FIG. 15 is a graph showing the CD8+ T cell/Treg cell ratio in tumors of the CT26 mouse tumor model treated with the indicated doses of DTAmIgG2a.

FIG. 16 is a graph showing a time course of tumor-free mice at the indicated doses of DTAmIgG2a.

DETAILED DESCRIPTION

Figure 1:
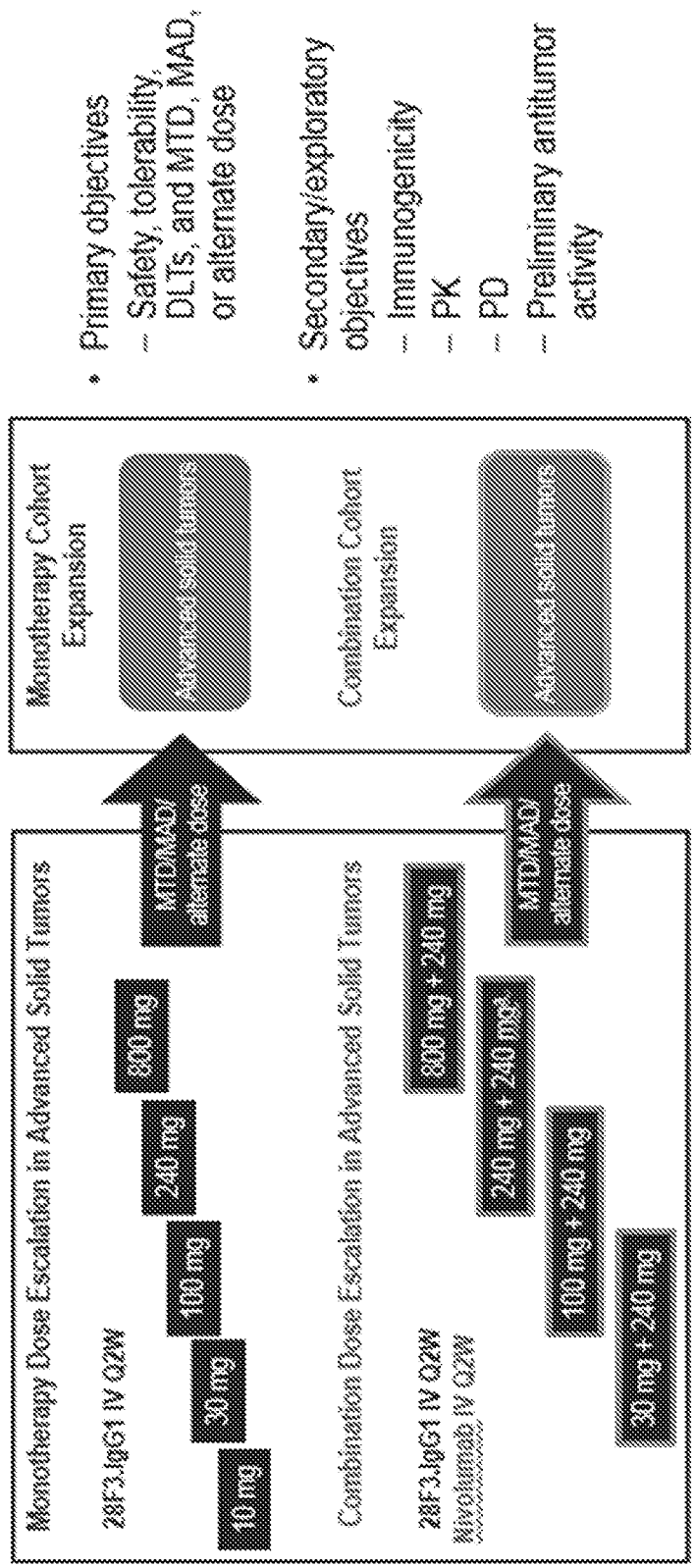
FIG. 1 shows the phase ½a study of 28F3.IgG1±nivolumab in patients with advanced solid tumors. DLT, dose-limiting toxicity; HCC, hepatocellular carcinoma; MAD, maximum administered dose; MTD, maximum tolerated dose; NSCLC, non-small cell lung cancer; PD, pharmacodynamics; PK, pharmacokinetics; SCCHN, squamous cell carcinoma of the head and neck; and Q2W, every 2 weeks.

Provided herein are methods of treatment of cancer with anti-GITR agonist agents, e.g., antibodies, and anti-PD-1 or anti-PD-L1 ("PD-1/PD-L1 axis") antagonist agents, e.g., antibodies.

Definitions

In order that the present description may be more readily understood, certain terms are first defined. Additional definitions are set forth throughout the detailed description.

The term "glucocorticoid-inducible TNF receptor" or "GITR" as used herein refers to a receptor that is a member of the TNF-receptor superfamily, which binds to GITR ligand (GITR-L). GITR is also referred to as tumor necrosis factor receptor superfamily, member 18 (TNFRSF18), AITR and CD357. The term "GITR" includes any variants or isoforms of GITR which are naturally expressed by cells. Accordingly, antibodies described herein may cross-react with GITR from species other than human (e.g., cynomolgus GITR). Alternatively, the antibodies may be specific for human GITR and may not exhibit any cross-reactivity with other species. GITR or any variants and isoforms thereof, may either be isolated from cells or tissues which naturally express them or be recombinantly produced using well-known techniques in the art and/or those described herein.

Three isoforms of human GITR have been identified, all of which share the same extracellular domain, except for its C-terminal portion. Variant 1 (Accession No. NP_004186; SEQ ID NO: 1) consists of 241 amino acids and represents the longest transcript. It contains an extra coding segment that leads to a frame shift, compared to variant 2. The resulting protein (isoform 1) contains a distinct and shorter C-terminus, as compared to isoform 2. Variant 2 (Accession No. NP_683699; SEQ ID NO: 2) encodes the longest protein (isoform 2), consisting of 255 amino acids, and is soluble. Variant 3 (Accession No. NP_683700; SEQ ID NO: 3) contains an extra coding segment that leads to a frame shift, compared to variant 2. The resulting protein (isoform 3) contains a distinct and shorter C-terminus, as compared to isoform 2, and consists of 234 amino acids.

Below are the amino acid sequences of the three known human GITR isoforms, cyno GITR and GITR-L.

```
Human GITR isoform 1 (Accession No. NP_004186;
SEQ ID NO: 1; encoded by the nucleotide sequence
having Accession No. NM_004195.2):
MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCTQFGFLTVFPGNKTHN

AVCVPGSPPAEPLGWLTVVLLAVAACVLLLTSAQLGLHIWQLRSQCMWPR

ETQLLLEVPPSTEDARSCQFPEEERGERSAEEKGRLGDLWV

Human GITR isoform 2 (Accession No. NP_683699.1;
SEQ ID NO: 2; encoded by the nucleotide sequence
having Accession No. NM_148901.1):
MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCCWRCRRRPKTPEAASS

PRKSGASDRQRRRGGWETCGCEPGRPPGPPTAASPSPGAPQAAGALRSAL

GRALLPWQQKWVQEGGSDQRPGPCSSAAAAGPCRRERETQSWPPSSLAGP

DGVGS

Human GITR isoform 3 (Accession No. NP_683700.1;
SEQ ID NO: 3; encoded by the nucleotide sequence
having Accession No. NM_148902.1):
MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCTQFGFLTVFPGNKTHN

AVCVPGSPPAEPLGWLTVVLLAVAACVLLLTSAQLGLHIWQLRKTQLLLE

VPPSTEDARSCQFPEEERGERSAEEKGRLGDLWV
```

The signal sequence of isoforms 1-3 corresponds to amino acids 1-25. Thus, the mature isoforms 1, 2 and 3 consist of amino acids 26 to 241, 255 or 234, respectively. The extracellular domain of mature GITR consists of amino acids 26-162 and has the amino acid sequence:

```
                                         (SEQ ID NO: 4)
QRPTGGPGCGPGRLLLGTGTDARCCRVHTTRCCRDYPGEECCSEWDCMCV

QPEFHCGDPCCTTCRHHPCPPGQGVQSQGKFSFGFQCIDCASGTFSGGHE

GHCKPWTDCTQFGFLTVFPGNKTHNAVCVPGSPPAEP

Cynomolgus GITR protein sequence (SEQ ID NO: 5):
MCASGTLCCLALLCAASLGQRPTGGPGCGPGRLLLGTGKDARCCRVHPTR

CCRDYQGEECCSEWDCVCVQPEFHCGNPCCTTCQHHPCPSGQGVQPQGKF

SFGFRCVDCALGTFSRGHDGHCKPWTDCTQFGFLTVFPGNKTHNAVCVPG

SPPAEPPGWLTIILLAVAACVLLLTSAQLGLHIWQLRSQPTGPRETQLLL

EVPPSTEDASSCQFPEEERGERLAEEKGRLGDLWV

Human GITR-L protein sequence (Accession No. NP_
005083.2; SEQ ID NO: 6):
MTLHPSPITCEFLFSTALISPKMCLSHLENMPLSHSRTQGAQRSSWKLWL

FCSIVMLLFLCSFSWLIFIFLQLETAKEPCMAKFGPLPSKWQMASSEPPC

VNKVSDWKLEILQNGLYLIYGQVAPNANYNDVAPFEVRLYKNKDMIQTLT

NKSKIQNVGGTYELHVGDTIDLIFNSEHQVLKNNTYWGIILLANPQFIS
```

The term "antibody" as used to herein includes whole antibodies and any antigen binding fragments (i.e., "antigen-binding portions") or single chains thereof. An "antibody" refers, in one embodiment, to a glycoprotein comprising at least two heavy (H) chains and two light (L) chains interconnected by disulfide bonds, or an antigen binding portion thereof. Each heavy chain is comprised of a heavy chain variable region (abbreviated herein as $V_H$) and a heavy chain constant region. In certain naturally occurring antibodies, the heavy chain constant region is comprised of three domains, CH1, CH2 and CH3. In certain naturally occurring antibodies, each light chain is comprised of a light chain variable region (abbreviated herein as $V_L$) and a light chain constant region. The light chain constant region is comprised of one domain, CL. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (Clq) of the classical complement system.

Antibodies typically bind specifically to their cognate antigen with high affinity, reflected by a dissociation constant ($K_D$) of $10^{-5}$ to $10^{-11}$ M or less. Any $K_D$ greater than about $10^{-4}$ M is generally considered to indicate nonspecific binding. As used herein, an antibody that "binds specifically" to an antigen refers to an antibody that binds to the antigen and substantially identical antigens with high affinity, which means having a $K_D$ of $10^{-7}$ M or less, preferably $10^{-8}$ M or less, even more preferably 5×10 M or less, and most preferably between $10^{-8}$ M and $10^{-10}$ M or less, but does not bind with high affinity to unrelated antigens. An antigen is "substantially identical" to a given antigen if it exhibits a high degree of sequence identity to the given antigen, for example, if it exhibits at least 80%, at least 90%, preferably at least 95%, more preferably at least 97%, or even more preferably at least 99% sequence identity to the sequence of the given antigen. By way of example, an antibody that binds specifically to human GITR may also have cross-reactivity with GITR antigens from certain primate species (e.g., cynomolgus GITR), but may not cross-react with GITR antigens from other species or with an antigen other than GITR.

An immunoglobulin may be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In certain embodiments, the anti-GITR antibodies described herein are of the IgG1 or IgG2 subtype. Immunoglobulins, e.g., IgG1, exist in several allotypes, which differ from each other in at most a few amino acids. "Antibody" includes, by way of example, both naturally occurring and non-naturally occurring antibodies; monoclonal and polyclonal antibodies; chimeric and humanized antibodies; human and nonhuman antibodies; wholly synthetic antibodies; and single chain antibodies. An antibody can be part of an antibody multimer (or multimeric antibody), e.g., dimer, trimer, tetramer, pentamer and hexamer.

The term "monoclonal antibody," as used herein, refers to an antibody that displays a single binding specificity and affinity for a particular epitope or a composition of antibodies in which all antibodies display a single binding specificity and affinity for a particular epitope.

Accordingly, the term "human monoclonal antibody" refers to an antibody or antibody composition that display(s) a single binding specificity and which has variable and optional constant regions derived from human germline immunoglobulin sequences. In one embodiment, human monoclonal antibodies are produced by a hybridoma which includes a B cell obtained from a transgenic non-human animal, e.g., a transgenic mouse, having a genome comprising a human heavy chain transgene and a light chain transgene fused to an immortalized cell.

A "human" antibody (HuMAb) refers to an antibody having variable regions in which both the framework and CDR regions are derived from human germline immunoglobulin sequences. Furthermore, if the antibody contains a constant region, the constant region also is derived from human germline immunoglobulin sequences. The antibodies described herein may include amino acid residues not encoded by human germline immunoglobulin sequences (e.g., mutations introduced by random or site-specific mutagenesis in vitro or by somatic mutation in vivo). However, the term "human antibody", as used herein, is not intended to include antibodies in which CDR sequences derived from the germline of another mammalian species, such as a mouse, have been grafted onto human framework sequences. The terms "human" antibodies and "fully human" antibodies are used synonymously.

A "humanized" antibody refers to an antibody in which some, most or all of the amino acids outside the CDR domains of a non-human antibody are replaced with corresponding amino acids derived from human immunoglobulins. In one embodiment of a humanized form of an antibody, some, most or all of the amino acids outside the CDR domains have been replaced with amino acids from human immunoglobulins, whereas some, most or all amino acids within one or more CDR regions are unchanged. Small additions, deletions, insertions, substitutions or modifications of amino acids are permissible as long as they do not abrogate the ability of the antibody to bind to a particular antigen. A "humanized" antibody retains an antigenic specificity similar to that of the original antibody.

A "chimeric antibody" refers to an antibody in which the variable regions are derived from one species and the constant regions are derived from another species, such as an antibody in which the variable regions are derived from a mouse antibody and the constant regions are derived from a human antibody.

As used herein, "isotype" refers to the antibody class (e.g., IgG1, IgG2, IgG3, IgG4, IgM, IgA1, IgA2, IgD, and IgE antibody) that is encoded by the heavy chain constant region genes.

"Allotype" refers to naturally occurring variants within a specific isotype group, which variants differ in a few amino acids (see, e.g., Jefferis et al. (2009) mAbs 1:1). Antibodies described herein may be of any allotype. As used herein, antibodies referred to as "IgG1f" or "IgG1.1f" isotype are IgG1 and effectorless IgG1.1 antibodies, respectively, of the allotype "f," i.e., having 214R, 356E and 358M according to the EU index as in Kabat, as shown, e.g., in SEQ ID NO: 7 (see underlined residues in SEQ ID NO: 7 of Table 2).

The phrases "an antibody recognizing an antigen" and "an antibody specific for an antigen" are used interchangeably herein with the term "an antibody which binds specifically to an antigen."

An "isolated antibody," as used herein, is intended to refer to an antibody which is substantially free of other antibodies having different antigenic specificities (e.g., an isolated antibody that specifically binds to GITR is substantially free of antibodies that specifically bind antigens other than GITR). An isolated antibody that specifically binds to an epitope of GITR may, however, have cross-reactivity to other GITR proteins from different species.

"Programmed Death-1 (PD-1)" refers to an immunoinhibitory receptor belonging to the CD28 family. PD-1 is expressed predominantly on previously activated T cells in vivo, and binds to two ligands, PD-L1 and PD-L2. The term "PD-1" as used herein includes human PD-1 (hPD-1), variants, isoforms, and species homologs of hPD-1, and analogs having at least one common epitope with hPD-1. The complete hPD-1 sequence can be found under GenBank Accession No. U64863.

"Programmed Death Ligand-1 (PD-L1)" is one of two cell surface glycoprotein ligands for PD-1 (the other being PD-L2) that down-regulate T cell activation and cytokine secretion upon binding to PD-1. The term "PD-L1" as used herein includes human PD-L1 (hPD-L1), variants, isoforms, and species homologs of hPD-L1, and analogs having at least one common epitope with hPD-L1. The complete hPD-L1 sequence can be found under GenBank Accession No. Q9NZQ7.

An "Fc region" (fragment crystallizable region) or "Fc domain" or "Fc" refers to the C-terminal region of the heavy chain of an antibody that mediates the binding of the immunoglobulin to host tissues or factors, including binding to Fc receptors located on various cells of the immune system (e.g., effector cells) or to the first component (C1q) of the classical complement system. Thus, an Fc region comprises the constant region of an antibody excluding the first constant region immunoglobulin domain (e.g., CH1 or CL). In IgG, IgA and IgD antibody isotypes, the Fc region comprises two identical protein fragments, derived from the second ($C_{H2}$) and third ($C_{H3}$) constant domains of the antibody's two heavy chains; IgM and IgE Fc regions comprise three heavy chain constant domains ($C_H$ domains 2-4) in each polypeptide chain. For IgG, the Fc region comprises immunoglobulin domains Cγ2 and Cγ3 and the hinge between Cγ1 and Cγ2. Although the boundaries of the Fc region of an immunoglobulin heavy chain might vary, the human IgG heavy chain Fc region is usually defined to stretch from an amino acid residue at position C226 or P230 (or amino acid between these two amino acids) to the carboxy-terminus of the heavy chain, wherein the numbering is according to the EU index as in Kabat. The $C_{H2}$ domain of a human IgG Fc region extends from about amino acid 231 to about amino acid 340, whereas the $C_{H3}$ domain is positioned on C-terminal side of a $C_{H2}$ domain in an Fc region, i.e., it extends from about amino acid 341 to about amino acid 447 of an IgG. As used herein, the Fc region may be a native sequence Fc, including any allotypic variant, or a variant Fc (e.g., a non-naturally occurring Fc). Fc may also refer to this region in isolation or in the context of an Fc-comprising protein polypeptide such as a "binding protein comprising an Fc region," also referred to as an "Fc fusion protein" (e.g., an antibody or immunoadhesin).

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc include the various allotypes of Fcs (see, e.g., Jefferis et al. (2009) mAbs 1:1).

A "hinge", "hinge domain" or "hinge region" or "antibody hinge region" refers to the domain of a heavy chain constant region that joins the CH1 domain to the CH2 domain and includes the upper, middle, and lower portions of the hinge (Roux et al. J. Immunol. 1998 161:4083). The hinge provides varying levels of flexibility between the binding and effector regions of an antibody and also provides sites for intermolecular disulfide bonding between the two heavy chain constant regions. As used herein, a hinge starts at Glu216 and ends at Gly237 for all IgG isotypes (Roux et al., 1998 J Immunol 161:4083). The sequences of wildtype IgG1, IgG2, IgG3 and IgG4 hinges are show in Tables 1 and 2.

TABLE 1

Hinge region amino acid sequences

| Ig Type | C-terminal CH1* | Upper Hinge | Middle Hinge | Lower Hinge |
|---|---|---|---|---|
| IgG1 | VDKRV (SEQ ID NO: 299) | EPKSCDKTHT (SEQ ID NO: 301) | CPPCP (SEQ ID NO: 305) | APELLGG (SEQ ID NO: 313) |
| IgG2 | VDKTV (SEQ ID NO: 300) | ERK | CCVECPPCP (SEQ ID NO: 306) | APPVAG (SEQ ID NO: 314) |
| IgG3 (17-15-15-15) | VDKRV (SEQ ID NO: 299) | ELKTPLGDTTHT (SEQ ID NO: 302) | CPRCP (EPKSCDTPPPCPRCP)$_3$ (SEQ ID NO: 307) | APELLGG (SEQ ID NO: 313) |
| IgG3 (17-15-15) | VDKRV (SEQ ID NO: 299) | ELKTPLGDTTHT (SEQ ID NO: 302) | CPRCP (EPKSCDTPPPCPRCP)$_2$ (SEQ ID NO: 308) | APELLGG (SEQ ID NO: 313) |
| IgG3 (17-15) | VDKRV (SEQ ID NO: 299) | ELKTPLGDTTHT (SEQ ID NO: 302) | CPRCP (EPKSCDTPPPCPRCP)$_1$ (SEQ ID NO: 309) | APELLGG (SEQ ID NO: 313) |
| IgG3 (15-15-15) | VDKRV (SEQ ID NO: 299) | EPKS (SEQ ID NO: 303) | CDTPPPCPRCP (EPKSCDTPPPCPRCP)$_2$ (SEQ ID NO: 310) | APELLGG (SEQ ID NO: 313) |
| IgG3 (15) | VDKRV (SEQ ID NO: 299) | EPKS (SEQ ID NO: 303) | CDTPPPCPRCP (SEQ ID NO: 311) | APELLGG (SEQ ID NO: 313) |
| IgG4 | VDKRV (SEQ ID NO: 299) | ESKYGPP (SEQ ID NO: 304) | CPSCP (SEQ ID NO: 312) | APEFLGG (SEQ ID NO: 313) |

*C-terminal amino acid sequences of the CH1 domains.

The term "hinge" includes wildtype hinges (such as those set forth in Table 1 or 2), as well as variants thereof (e.g., non-naturally-occurring hinges or modified hinges). For example, the term "IgG2 hinge" includes wildtype IgG2 hinge, as shown in Table 1 or 2, and variants having 1, 2, 3, 4, 5, 1-3, 1-5, 3-5 and/or at most 5, 4, 3, 2, or 1 mutations, e.g., substitutions, deletions or additions. Exemplary IgG2 hinge variants include IgG2 hinges in which 1, 2, 3 or all 4 cysteines (C219, C220, C226 and C229) are changed to another amino acid. In a specific embodiment, an IgG2 comprises a C219S substitution. In certain embodiments, a hinge is a hybrid hinge that comprises sequences from at least two isotypes. For example, a hinge may comprise the upper, middle or lower hinge from one isotype and the remainder of the hinge from one or more other isotypes. For example, a hinge can be an IgG2/IgG1 hinge, and may comprise, e.g., the upper and middle hinges of IgG2 and the lower hinge of IgG1. A hinge may have effector function or be deprived of effector function. For example, the lower hinge of wildtype IgG1 provides effector function.

The term "CH1 domain" refers to the heavy chain constant region linking the variable domain to the hinge in a heavy chain constant domain. As used herein, a CH1 domain starts at A118 and ends at V215. The term "CH1 domain" includes wildtype CH1 domains (such as having SEQ ID NO: 278 for IgG1 and SEQ ID NO: 279 for IgG2; Table 2), as well as variants thereof (e.g., non-naturally-occurring CH1 domains or modified CH1 domains). For example, the term "CH1 domain" includes wildtype CH1 domains and variants having 1, 2, 3, 4, 5, 1-3, 1-5, 3-5 and/or at most 5, 4, 3, 2, or 1 mutations, e.g., substitutions, deletions or additions. Exemplary CH1 domains include CH1 domains with mutations that modify a biological activity of an antibody, such as ADCC, CDC or half-life. Modifications to the CH1 domain that affect a biological activity of an antibody are provided herein.

The term "CH2 domain" refers to the heavy chain constant region linking the hinge to the CH3 domain in a heavy chain constant domain. As used herein, a CH2 domain starts at P238 and ends at K340. The term "CH2 domain" includes wildtype CH2 domains (such as having SEQ ID NO: 280 for IgG1 and SEQ ID NO: 297 for IgG2; Table 2), as well as variants thereof (e.g., non-naturally-occurring CH2 domains or modified CH2 domains). For example, the term "CH2 domain" includes wildtype CH2 domains and variants having 1, 2, 3, 4, 5, 1-3, 1-5, 3-5 and/or at most 5, 4, 3, 2, or 1 mutations, e.g., substitutions, deletions or additions. Exemplary CH2 domains include CH2 domains with mutations that modify a biological activity of an antibody, such as ADCC, CDC or half-life. In certain embodiments, a CH2 domain comprises the substitutions A330S/P331S that reduce effector function. Other modifications to the CH2 domain that affect a biological activity of an antibody are provided herein.

The term "CH3 domain" refers to the heavy chain constant region that is C-terminal to the CH2 domain in a heavy chain constant domain. As used herein, a CH3 domain starts at G341 and ends at K447. The term "CH3 domain" includes wildtype CH3 domains (such as having SEQ ID NO: 282 for IgG1 and SEQ ID NO: 298 for IgG2; Table 2), as well as variants thereof (e.g., non-naturally-occurring CH3 domains or modified CH3 domains). For example, the term "CH3 domain" includes wildtype CH3 domains and variants having 1, 2, 3, 4, 5, 1-3, 1-5, 3-5 and/or at most 5, 4, 3, 2, or 1 mutations, e.g., substitutions, deletions or additions. Exemplary CH3 domains include CH3 domains with mutations that modify a biological activity of an antibody, such as ADCC, CDC or half-life. Modifications to the CH3 domain that affect a biological activity of an antibody are provided herein.

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc includes the various allotypes of Fcs (see, e.g., Jefferis et al. (2009) mAbs 1:1).

The term "epitope" or "antigenic determinant" refers to a site on an antigen (e.g., GITR) to which an immunoglobulin or antibody specifically binds. Epitopes can be formed both from contiguous amino acids (usually a linear epitope) or noncontiguous amino acids juxtaposed by tertiary folding of a protein (usually a conformational epitope). Epitopes formed from contiguous amino acids are typically, but not always, retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immunoprecipitation assays, wherein overlapping or contiguous peptides from (e.g., from GITR) are tested for reactivity with a given antibody (e.g., anti-GITR antibody). Methods of determining spatial conformation of epitopes include techniques in the art and those described herein, for example, x-ray crystallography, 2-dimensional nuclear magnetic resonance and HDX-MS (see, e.g., *Epitope Mapping Protocols in Methods in Molecular Biology*, Vol. 66, G. E. Morris, Ed. (1996)).

The term "epitope mapping" refers to the process of identification of the molecular determinants for antibody-antigen recognition.

The term "binds to the same epitope" with reference to two or more antibodies means that the antibodies bind to the same segment of amino acid residues, as determined by a given method. Techniques for determining whether antibodies bind to the "same epitope on GITR" with the antibodies described herein include, for example, epitope mapping methods, such as, x-ray analyses of crystals of antigen: antibody complexes which provides atomic resolution of the epitope and hydrogen/deuterium exchange mass spectrometry (HDX-MS). Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. These methods rely on the ability of the antibody of interest to affinity isolate specific short peptides from combinatorial phage display peptide libraries. Antibodies having the same VH and VL or the same CDR1, 2 and 3 sequences are expected to bind to the same epitope.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments. In certain embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the "blocking antibody" (i.e., the cold antibody that is incubated first with the target). Competition assays can be conducted as described, for example, in Ed Harlow and David Lane, Cold Spring Harb Protoc; 2006; doi:10.1101/pdb.prot4277 or in Chapter 11 of "Using Antibodies" by Ed Harlow and David Lane, Cold Spring Harbor Laboratory Press, Cold Spring Harbor, N.Y., USA 1999. Competing antibodies bind to the same epitope, an overlapping epitope or to adjacent epitopes (e.g., as evidenced by steric hindrance).

Other competitive binding assays include: solid phase direct or indirect radioimmunoassay (RIA), solid phase direct or indirect enzyme immunoassay (EIA), sandwich competition assay (see Stahli et al., *Methods in Enzymology* 9:242 (1983)); solid phase direct biotin-avidin EIA (see Kirkland et al., *J. Immunol.* 137:3614 (1986)); solid phase direct labeled assay, solid phase direct labeled sandwich assay (see Harlow and Lane, *Antibodies: A Laboratory Manual*, Cold Spring Harbor Press (1988)); solid phase direct label RIA using 1-125 label (see Morel et al., *Mol. Immunol.* 25(1):7 (1988)); solid phase direct biotin-avidin EIA (Cheung et al., *Virology* 176:546 (1990)); and direct labeled RIA. (Moldenhauer et al., *Scand. J. Immunol.* 32:77 (1990)).

As used herein, the terms "specific binding," "selective binding," "selectively binds," and "specifically binds," refer to antibody binding to an epitope on a predetermined antigen. Typically, the antibody (i) binds with an equilibrium dissociation constant ($K_D$) of approximately less than $10^{-7}$ M, such as approximately less than $10^{-8}$ M, $10^{-9}$ M or $10^{-10}$ M or even lower when determined by, e.g., surface plasmon resonance (SPR) technology in a BIACORE 2000 instrument using the predetermined antigen, e.g., recombinant human GITR, as the analyte and the antibody as the ligand, or Scatchard analysis of binding of the antibody to antigen positive cells, and (ii) binds to the predetermined antigen with an affinity that is at least two-fold greater than its affinity for binding to a non-specific antigen (e.g., BSA, casein) other than the predetermined antigen or a closely-related antigen. Accordingly, an antibody that "specifically binds to human GITR" refers to an antibody that binds to soluble or cell bound human GITR with a $K_D$ of $10^{-7}$ M or less, such as approximately less than $10^{-8}$ M, $10^{-9}$ M or $10^{-10}$ M or even lower. An antibody that "cross-reacts with cynomolgus GITR" refers to an antibody that binds to cynomolgus GITR with a $K_D$ of $10^{-7}$ M or less, such as approximately less than $10^{-8}$ M, $10^{-9}$ M or $10^{-10}$ M or even lower. In certain embodiments, such antibodies that do not cross-react with GITR from a non-human species exhibit essentially undetectable binding against these proteins in standard binding assays.

The term "naturally-occurring" as used herein as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

A "polypeptide" refers to a chain comprising at least two consecutively linked amino acid residues, with no upper limit on the length of the chain. One or more amino acid residues in the polypeptide may contain a modification such as, but not limited to, glycosylation, phosphorylation or disulfide bond formation. A "protein" may comprise one or more polypeptides.

The term "nucleic acid molecule," as used herein, is intended to include DNA molecules and RNA molecules. A nucleic acid molecule may be single-stranded or double-stranded, and may be cDNA.

Also provided are "conservative sequence modifications" of the sequences set forth herein, e.g., in Table 2, such as in SEQ ID NOs: 13-191, i.e., nucleotide and amino acid sequence modifications which do not abrogate the binding of the antibody encoded by the nucleotide sequence or containing the amino acid sequence, to the antigen. Such conservative sequence modifications include conservative nucleotide and amino acid substitutions, as well as, nucleotide and amino acid additions and deletions. For example, modifications can be introduced into a sequence in Table 2, e.g., SEQ ID NOs: 13-191, by standard techniques known in the art, such as site-directed mutagenesis and PCR-mediated mutagenesis. Conservative amino acid substitutions include ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, a predicted nonessential amino acid residue in an anti-GITR antibody is preferably replaced with another amino acid residue from the same side chain family. Methods of identifying nucleotide and amino acid conservative substitutions which do not eliminate antigen binding are well-known in the art (see, e.g., Brummell et al., *Biochem.* 32:1180-1187 (1993); Kobayashi et al. *Protein Eng.* 12(10):879-884 (1999); and Burks et al. *Proc. Natl. Acad. Sci. USA* 94:412-417 (1997)). Alternatively, in certain embodiments, mutations can be introduced randomly along all or part of an anti-GITR antibody coding sequence, such as by saturation mutagenesis, and the resulting modified anti-GITR antibodies can be screened for binding activity.

For polypeptides, the term "substantial homology" indicates that two polypeptides, or designated sequences thereof, when optimally aligned and compared, are identical, with appropriate amino acid insertions or deletions, in at least about 80% of the amino acids, usually at least about 90% to 95%, and more preferably at least about 98% to 99.5% of the amino acids. The percent identity between two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide or amino acid sequences can also be determined using the algorithm of E. Meyers and W. Miller (CABIOS, 4:11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* (48):444-453 (1970)) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6.

The nucleic acid and protein sequences described herein can further be used as a "query sequence" to perform a search against public databases to, for example, identify related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to the nucleic acid molecules described herein. BLAST protein searches can be performed with the XBLAST program, score=50, wordlength=3 to obtain amino acid sequences homologous to the protein molecules described herein. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used. See www.ncbi.nlm.nih.gov.

An "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell or a Th cell, such as a CD4+ or CD8+ T cell, or the inhibition of a Treg cell.

An "immunomodulator" or "immunoregulator" refers to an agent, e.g., a component of a signaling pathway, that may be involved in modulating, regulating, or modifying an immune response. "Modulating," "regulating," or "modifying" an immune response refers to any alteration in a cell of the immune system or in the activity of such cell (e.g., an effector T cell). Such modulation includes stimulation or suppression of the immune system which may be manifested by an increase or decrease in the number of various cell types, an increase or decrease in the activity of these cells, or any other changes which can occur within the immune system. Both inhibitory and stimulatory immunomodulators have been identified, some of which may have enhanced function in a tumor microenvironment. In preferred embodiments, the immunomodulator is located on the surface of a T cell. An "immunomodulatory target" or "immunoregulatory target" is an immunomodulator that is targeted for binding by, and whose activity is altered by the binding of, a substance, agent, moiety, compound or molecule. Immunomodulatory targets include, for example, receptors on the surface of a cell ("immunomodulatory receptors") and receptor ligands ("immunomodulatory ligands").

"Immunotherapy" refers to the treatment of a subject afflicted with, or at risk of contracting or suffering a recurrence of, a disease by a method comprising inducing, enhancing, suppressing or otherwise modifying an immune response.

"Immunostimulating therapy" or "immunostimulatory therapy" refers to a therapy that results in increasing (inducing or enhancing) an immune response in a subject for, e.g., treating cancer.

"Potentiating an endogenous immune response" means increasing the effectiveness or potency of an existing immune response in a subject. This increase in effectiveness and potency may be achieved, for example, by overcoming mechanisms that suppress the endogenous host immune response or by stimulating mechanisms that enhance the endogenous host immune response.

"T effector" ("$T_{eff}$") cells refers to T cells (e.g., CD4+ and CD8+ T cells) with cytolytic activities as well as T helper (Th) cells, which secrete cytokines and activate and direct other immune cells, but does not include regulatory T cells (Treg cells). Anti-GITR antibodies described herein activate $T_{eff}$ cells, e.g., CD4+ and CD8+ $T_{eff}$ cells.

An increased ability to stimulate an immune response or the immune system, can result from an enhanced agonist activity of T cell costimulatory receptors and/or an enhanced antagonist activity of inhibitory receptors. An increased ability to stimulate an immune response or the immune system may be reflected by a fold increase of the $EC_{50}$ or maximal level of activity in an assay that measures an immune response, e.g., an assay that measures changes in cytokine or chemokine release, cytolytic activity (determined directly on target cells or indirectly via detecting CD107a or granzymes) and proliferation. The ability to stimulate an immune response or the immune system activity may be enhanced by at least 10%, 30%, 50%, 75%, 2 fold, 3 fold, 5 fold or more.

An agonist activity of an antibody can be determined, e.g., by measuring the level of IFN-γ or IL-2 secretion from T cells that are contacted with the antibody. The agonist activity of one agonist agent, e.g., an antibody, may be higher by at least 10%, 30%, 50%, 75%, 2 fold, 3 fold, 5 fold or more relative to another agonist agent, as defined by increased cytokine release or increased proliferation in effector T cells; reduced T regulatory cell activity if engagement on Tregs reduces Treg function; or increased depletion of Tregs. For example, the amount of IFN-γ or IL-2 secreted from T cells stimulated with a first agonist agent, e.g., antibody, may be at least 10%, 30%, 50%, 75%, 2 fold, 3 fold, 5 fold or more higher than that of T cells simulated with the a second agonist agent, e.g., antibody.

An "agonist" of a ligand or receptor is an agent that mirrors the activity of the natural ligand/receptor interaction. 28F3.IgG1 is an exemplary GITR agonist antibody.

An "antagonist" of a ligand or receptor is an agent that inhibits the interaction between the ligand and the receptor. Nivolumab is an exemplary PD-1 antagonist antibody.

As used herein, the term "linked" refers to the association of two or more molecules. The linkage can be covalent or non-covalent. The linkage also can be genetic (i.e., recombinantly fused). Such linkages can be achieved using a wide variety of art recognized techniques, such as chemical conjugation and recombinant protein production.

As used herein, "administering" refers to the physical introduction of a composition comprising a therapeutic agent to a subject, using any of the various methods and delivery systems known to those skilled in the art, e.g., intravenous. Routes of administration for antibodies described herein include intravenous, intraperitoneal, intramuscular, subcutaneous, spinal or other parenteral routes of administration, for example by injection or infusion. The phrase "parenteral administration" as used herein means modes of administration other than enteral and topical administration, usually by injection, and includes, without limitation, intravenous, intraperitoneal, intramuscular, intraarterial, intrathecal, intralymphatic, intralesional, intracapsular, intraorbital, intracardiac, intradermal, transtracheal, subcutaneous, subcuticular, intraarticular, subcapsular, subarachnoid, intraspinal, epidural and intrasternal injection and infusion, as well as in vivo electroporation. Alternatively, an antibody described herein can be administered via a non-parenteral route, such as a topical, epidermal or mucosal route of administration, for example, intranasally, orally, vaginally, rectally, sublingually or topically. Administering can also be performed, for example, once, a plurality of times, and/or over one or more extended periods.

As used herein, the term "T cell-mediated response" refers to a response mediated by T cells, including effector T cells (e.g., $CD8^+$ cells) and helper T cells (e.g., $CD4^+$ cells). T cell mediated responses include, for example, T cell cytotoxicity and proliferation.

As used herein, the term "cytotoxic T lymphocyte (CTL) response" refers to an immune response induced by cytotoxic T cells. CTL responses are mediated primarily by $CD8^+$ T cells.

As used herein, the terms "inhibits" or "blocks" (e.g., referring to inhibition/blocking of binding of GITR-L to GITR on cells or PD-1 to PD-L1 or PD-L2 on cells) are used interchangeably and encompass both partial and complete inhibition/blocking. In some embodiments, the anti-GITR antibody inhibits binding of GITR-L to GITR by at least about 50%, for example, about 60%, 70%, 80%, 90%, 95%, 99%, or 100%, determined, e.g., as further described herein. In some embodiments, the anti-GITR antibody inhibits binding of GITR-L to GITR by no more than 50%, for example, by about 40%, 30%, 20%, 10%, 5% or 1%, determined, e.g., as further described herein.

As used herein, the term "inhibits growth" of a tumor includes any measurable decrease in the growth of a tumor, e.g., the inhibition of growth of a tumor by at least about 10%, for example, at least about 20%, at least about 30%, at least about 40%, at least about 50%, at least about 60%, at least about 70%, at least about 80%, at least about 90%, at least about 99%, or 100%.

As used herein, "cancer" refers a broad group of diseases characterized by the uncontrolled growth of abnormal cells in the body. Unregulated cell division may result in the formation of malignant tumors or cells that invade neighboring tissues and may metastasize to distant parts of the body through the lymphatic system or bloodstream.

The terms "treat," "treating," and "treatment," as used herein, refer to any type of intervention or process performed on, or administering an active agent to, the subject with the objective of reversing, alleviating, ameliorating, inhibiting, or slowing down or preventing the progression, development, severity or recurrence of a symptom, complication, condition or biochemical indicia associated with a disease. Treatment can be of a subject having a disease or a subject who does not have a disease (e.g., for prophylaxis).

A "hematological malignancy" includes a lymphoma, leukemia, myeloma or a lymphoid malignancy, as well as a cancer of the spleen and the lymph nodes. Exemplary lymphomas include both B cell lymphomas (a B-cell hematological cancer) and T cell lymphomas. B-cell lymphomas include both Hodgkin's lymphomas and most non-Hodgkin's lymphomas. Non-limiting examples of B cell lymphomas include diffuse large B-cell lymphoma, follicular lymphoma, mucosa-associated lymphatic tissue lymphoma, small cell lymphocytic lymphoma (overlaps with chronic lymphocytic leukemia), mantle cell lymphoma (MCL), Burkitt's lymphoma, mediastinal large B cell lymphoma, Waldenström macroglobulinemia, nodal marginal zone B cell lymphoma, splenic marginal zone lymphoma, intravascular large B-cell lymphoma, primary effusion lymphoma, lymphomatoid granulomatosis. Non-limiting examples of T cell lymphomas include extranodal T cell lymphoma, cutaneous T cell lymphomas, anaplastic large cell lymphoma, and angioimmunoblastic T cell lymphoma. Hematological malignancies also include leukemia, such as, but not limited to, secondary leukemia, chronic lymphocytic leukemia, acute myelogenous leukemia, chronic myelogenous leukemia, and acute lymphoblastic leukemia. Hematological malignancies further include myelomas, such as, but not limited to, multiple myeloma and smoldering multiple myeloma. Other hematological and/or B cell- or T-cell-associated cancers are encompassed by the term hematological malignancy.

The term "effective dose" or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A therapeutically effective amount or dosage of a drug includes a "prophylactically effective amount" or a "prophylactically effective dosage", which is any amount of the drug that, when administered alone or in combination with another therapeutic agent to a subject at risk of developing a disease or of suffering a recurrence of disease, inhibits the development or recurrence of the disease. The ability of a therapeutic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

By way of example, an anti-cancer agent is a drug that promotes cancer regression in a subject. In preferred embodiments, a therapeutically effective amount of the drug promotes cancer regression to the point of eliminating the cancer. "Promoting cancer regression" means that administering an effective amount of the drug, alone or in combination with an anti-neoplastic agent, results in a reduction in tumor growth or size, necrosis of the tumor, a decrease in severity of at least one disease symptom, an increase in frequency and duration of disease symptom-free periods, a prevention of impairment or disability due to the disease affliction, or otherwise amelioration of disease symptoms in the patient. In addition, the terms "effective" and "effectiveness" with regard to a treatment includes both pharmacological effectiveness and physiological safety. Pharmacological effectiveness refers to the ability of the drug to promote cancer regression in the patient. Physiological safety refers to the level of toxicity, or other adverse physiological effects at the cellular, organ and/or organism level (adverse effects) resulting from administration of the drug.

By way of example for the treatment of tumors, a therapeutically effective amount or dosage of the drug preferably inhibits cell growth or tumor growth by at least about 20%, more preferably by at least about 40%, even more preferably by at least about 60%, and still more preferably by at least about 80% relative to untreated subjects. In the most preferred embodiments, a therapeutically effective amount or dosage of the drug completely inhibits cell growth or tumor growth, i.e., preferably inhibits cell growth or tumor growth by 100%. The ability of a compound to inhibit tumor growth can be evaluated using the assays described infra. Alternatively, this property of a composition can be evaluated by examining the ability of the compound to inhibit cell growth, such inhibition can be measured in vitro by assays known to the skilled practitioner. In other preferred embodiments described herein, tumor regression may be observed and continue for a period of at least about 20 days, more preferably at least about 40 days, or even more preferably at least about 60 days.

The term "patient" includes human and other mammalian subjects that receive either prophylactic or therapeutic treatment.

As used herein, the term "subject" includes any human or non-human animal. For example, the methods and compositions described herein can be used to treat a subject having cancer.

"Therapeutic synergy" refers to a phenomenon where treatment of patients with a combination of therapeutic agents manifests a therapeutically superior outcome to the outcome achieved by each individual constituent of the combination used at its optimum dose (Corbett, T. H. et al., *Cancer Treatment Reports,* 66:1187 (1982)). For example, a therapeutically superior outcome is one in which the patients either a) exhibit fewer incidences of adverse events while receiving a therapeutic benefit that is equal to or greater than that where individual constituents of the combination are each administered as monotherapy at the same dose as in the combination, or b) do not exhibit dose-limiting toxicities while receiving a therapeutic benefit that is greater than that of treatment with each individual constituent of the combination when each constituent is administered in at the same doses in the combination(s) as is administered as individual components.

Methods of Treating Cancer

An anti-GITR agonist agent, such as an anti-GITR agonist Ab, may be administered to a subject having cancer, e.g., an advanced solid tumor, at a flat dose of 3 mg, 10 mg, 30 mg, 100 mg, 240 mg, 480 mg, 600 mg, 800 mg or 1000 mg of an anti-GITR agonist agent, e.g., an Ab, once every week, once every two weeks, once every 3 weeks, once every 4 weeks, once every 5 weeks, once every 6 weeks, once every 7 weeks or once every 8 weeks. The treatment may be administered in 8 week cycles, e.g., one 8 week cycle, two 8 week cycles, three 8 week cycles, four 8 week cycles, five 8 week cycles, six 8 week cycles, or more. Once cycle may comprise 8, 7, 6, 5, 4, 3, 2 or 1 administration of the anti-GITR agonist agent, such as an antibody. One cycle preferably comprises 4 administrations with one administration every two weeks. The treatment may be a monotherapy or part of a combination therapy.

An anti-GITR agonist agent, e.g., Ab, may be administered to a subject having cancer, e.g., an advanced solid tumor, as a combination therapy with an anti-PD-1 or anti-PD-L1 antagonist agent, e.g., Ab, at a flat dose of 3 mg, 10 mg, 30 mg, 100 mg, 200 mg, 240 mg, 250 mg, 300 mg, 400 mg, 480 mg, 500 mg, 600 mg, 700 mg, 800 mg, 900 mg or 1000 mg (e.g., 30 mg to 1000 mg; 30 mg to 800 mg; 100 mg to 800 mg; 100 mg to 600 mg) of an anti-GITR agonist agent, e.g., an Ab, once every week, once every two weeks, once every 3 weeks, once every 4 weeks, once every 5 weeks, once every 6 weeks, once every 7 weeks or once every 8 weeks. The treatment may be administered in 8 week cycles, e.g., one 8 week cycle, two 8 week cycles, three 8 week cycles, four 8 week cycles, five 8 week cycles, six 8 week cycles, or more. The anti-PD-1 or anti-PD-L1 antagonist, e.g., antibody, may be administered at a flat dose of, e.g., 100-500 mg, 200 mg-500 mg, 100-300 mg, such as, 200-300 mg, 220-260 mg, 230-250 mg, 120 mg, 240 mg or 480 mg.

An anti-GITR agonist agent, e.g., Ab, as monotherapy or combination therapy (a "first therapy") may be administered to a subject having cancer, e.g., an advanced solid tumor, for 1-6 cycles, followed by a rest period (a "follow-up period") and then retreatment with an anti-GITR agonist agent, e.g., Ab, as monotherapy or combination therapy (a "second therapy"). The first dose of the re-treatment (i.e., second therapy) may be administered within 6, 7, 8, 9, 10, 11, 12, 13, 14, 15, 16 or more months after the last dose of the first therapy. In certain embodiments, the first dose of the retreatment occurs within 12 months of the last dose of the first therapy.

Exemplary combination therapies comprise an anti-GITR agonist agent, e.g., Ab, and an anti-PD-1 or anti-PD-L1 antagonist agent, e.g., an antagonist Ab. In certain embodiments, an anti-GITR agonist agent, e.g., Ab, is infused first, followed by an infusion of a PD-1 or PD-L1 antagonist agent. For example, an anti-GITR agent, e.g., Ab, may be administered by infusion for a period of 30-60 minutes, followed by an infusion of an anti-PD-1 or anti-PD-L1 agent over a period of 30-60 minutes. In certain embodiments, an anti-PD-1 or anti-PD-L1 agent is administered by infusion for a period of 30-60 minutes, followed by an infusion of an anti-GITR agonist agent, e.g., Ab, over a period of 30-60 minutes. In certain embodiments, the two infusions are separated by a time period, e.g., 10 minutes, 30 minutes, 60 minutes, 2 hours, 3 hours, 6 hours, 12 hours, 24 hours, 10 minutes to 12 hours, 10 minutes to 6 hours, 10 minutes to 3 hours, or 20 minutes to 2 hours.

An anti-GITR agonist agent, e.g., Ab, and an anti-PD-1 or anti-PD-L1 antagonist agent, e.g., Ab, may be administered at the same time, and may be coformulated.

An exemplary combination therapy comprises administering an anti-GITR agonist agent, e.g., Ab, in combination with the anti-PD-1 Ab nivolumab. Nivolumab may be administered at a flat dose of 240 mg every two weeks.

An anti-GITR agonist agent, e.g., Ab, may be administered via infusion, e.g., an infusion over a period of at least 30 minutes, e.g., 30-60 or 30-90 minutes. For example, an anti-GITR agonist agent, e.g., Ab, may be administered by infusion over a period of 30 minutes or a period of 60 minutes. An anti-GITR agent, e.g., Ab, e.g., for administration by infusion, may be provided as a formulation of 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 20 mg/ml or more.

An exemplary treatment, e.g., monotherapy, comprises administering to a subject having an advanced solid tumor a 1 mg flat dose of an anti-GITR agonist agent, e.g., Ab, administered as an IV infusion, e.g., over 60 minutes, every 2 weeks. A treatment may comprise administering to a subject having an advanced solid tumor a 3 mg flat dose of an anti-GITR agonist agent, e.g., Ab, administered as an IV infusion, e.g., over 60 minutes, every 2 weeks. A treatment may comprise administering to a subject having an advanced solid tumor a 10 mg flat dose of an anti-GITR agonist agent, e.g., Ab, administered as an IV infusion, e.g., over 60 minutes, every 2 weeks. A treatment may comprise administering to a subject having an advanced solid tumor a 30 mg flat dose of an anti-GITR agonist agent, e.g., Ab, administered as an IV infusion, e.g., over 60 minutes, every 2 weeks. A treatment may comprise administering to a subject having an advanced solid tumor a 100 mg flat dose of an anti-GITR agonist agent, e.g., Ab, administered as an IV infusion, e.g., over 60 minutes, every 2 weeks. A treatment may comprise administering to a subject having an advanced solid tumor a 240 mg flat dose of an anti-GITR agonist agent, e.g., Ab, administered as an IV infusion, e.g., over 800 minutes, every 2 weeks. A treatment may comprise administering to a subject having an advanced solid tumor a 800 mg flat dose of an anti-GITR agonist agent, e.g., Ab, administered as an IV infusion, e.g., over 800 minutes, every 2 weeks.

An exemplary combination treatment comprises administering to a subject having an advanced solid tumor a 1 mg flat dose of an anti-GITR agonist agent, e.g., Ab, and an anti-PD-1 or anti-PD-L1 antagonist agent, e.g., nivolumab, at a flat dose of 240 mg, administered together or separately, as one or two IV infusions, e.g., over 30-60 minutes each, every 2 weeks. A treatment may comprise administering to a subject having an advanced solid tumor a 3 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A treatment may comprise administering to a subject having an advanced solid tumor a 10 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A treatment may comprise administering to a subject having an advanced solid tumor a 30 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A treatment may comprise administering to a subject having an advanced solid tumor a 100 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A treatment may comprise administering to a subject having an advanced solid tumor a 240 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A treatment may comprise administering to a subject having an advanced solid tumor a 800 mg flat dose of an anti-GITR agonist agent, e.g., Ab, and an anti-PD-1 or anti-PD-L1 antagonist agent, e.g., nivolumab, at a flat dose of 240 mg, both administered together or separately, as one or two IV infusions, e.g., over 30-60 minutes each, every 2 weeks. A combination treatment may exhibit a therapeutic synergy.

An exemplary combination treatment comprises administering to a subject having an advanced solid tumor a 1 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 3 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 10 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 30 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 100 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 240 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A treatment may comprise administering to a subject having an advanced solid tumor a 800 mg flat dose of an anti-GITR agonist agent, e.g., Ab, and an anti-PD-1 or anti-PD-L1 antagonist agent, e.g., nivolumab, at a flat dose of 120 mg, administered together or separately, as one or two IV infusions, e.g., over 30-60 minutes each, every week. A combination treatment may exhibit a therapeutic synergy.

An exemplary combination treatment comprises administering to a subject having an advanced solid tumor a 1 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 3 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 10 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 30 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 100 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 240 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 360 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 460 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 600 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A treatment may comprise administering to a subject having an advanced solid tumor a 800 mg flat dose of an anti-GITR agonist agent, e.g., Ab, and an anti-PD-1 or anti-PD-L1 antagonist agent, e.g., nivolumab, at a flat dose of 360 mg, administered together or separately, as one or two IV infusions, e.g., over 30-60 minutes each, every 3 weeks. A combination treatment may exhibit a therapeutic synergy.

An exemplary combination treatment comprises administering to a subject having an advanced solid tumor a 1 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 3 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 10 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 30 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 100 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 240 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 360 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 480 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 600 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A treatment may comprise administering to a subject having an advanced solid tumor a 800 mg flat dose of an anti-GITR agonist agent, e.g., Ab, and an anti-PD-1 or anti-PD-L1 antagonist agent, e.g., nivolumab, at a flat dose of 480 mg, administered together or separately, as one or two IV infusions, e.g., over 30-60 minutes each, every 4 weeks. A combination treatment may exhibit a therapeutic synergy.

An anti-GITR agonist agent, e.g., Ab, may be administered to patients who have lung cancer, such as non-small cell lung cancer (NSCLC), e.g., NSCLC subjects with progressive or recurrent disease during or after prior platinum doublet-based chemotherapy, followed by recurrent or progressive disease (per RECIST v1.1) during or after subsequent anti-PD-1 or anti-PD-L1 therapy. An anti-GITR agonist agent, e.g., Ab, may be administered to patients who have cervical cancer, such as persistent, recurrent or metastatic cervical cancer.

An anti-GITR agonist agent, e.g., Ab, may be administered in combination with an anti-PD-1 or anti-PD-L1 agent, e.g., nivolumab, in the following types of subjects (i) NSCLC subjects with progressive or recurrent disease during or after prior platinum doublet-based chemotherapy followed by progressive or recurrent disease (per RECIST v1.1) during or after subsequent anti-PD-1 or anti-PD-L1 therapy (ii) NSCLC subjects with progressive or recurrent disease during or after platinum doublet-based chemotherapy with no prior anti-PD-1 or anti-PD-L1 therapy, and (iii) persistent, recurrent or metastatic cervical cancer.

Treatment, e.g., monotherapy, may consists of up to three, 8-week treatment cycles, wherein, e.g., each treatment cycle comprises 4 doses of an anti-GITR agonist agent, e.g., Ab administered every 2 weeks on Days 1, 15, 29, and 43 of the treatment cycle. For combination treatments, each treatment cycle may comprise 4 doses of an anti-GITR agonist agent, e.g., Ab, (administered on Days 1, 15, 29 and 43) in combination with 4 doses of an anti-PD-1 or anti-PD-L1 agent, e.g., nivolumab, administered on Days 1, 15, 29, and 43 of the treatment cycle. When an anti-GITR agonist agent, e.g., Ab, and anti-PD-1 or an anti-PD-L1 agent are given, the anti-PD-1 or an anti-PD-L1 agent may be given first followed by the anti-GITR agonist agent, e.g., Ab, at least 30 minutes (e.g., 30 minutes to 3, 4, or 5 hours) after completion of the infusion of the anti-PD-1 or an anti-PD-L1 agent.

Subjects completing approximately 24 weeks (e.g., 6 months) of treatment with ongoing disease control (complete remission (CR), partial remission (PR) or stable disease (SD) or unconfirmed progressive disease (PD)) may receive an additional 3 cycles of monotherapy or combination therapy beyond the initial 24 weeks.

Cancer may be monitored by radiologic (e.g., tumor scans) and clinical tumor assessments, e.g., every 12 weeks or every six months.

Patients receiving an anti-GITR agonist agent, e.g., Ab, as monotherapy or as part of a combination therapy may have post-chemotherapy NSCLC or advanced/metastatic cervical cancer.

Following each treatment cycle, the decision to treat a subject with additional cycles of anti-GITR agonist agent, e.g., Ab, as monotherapy or combination therapy, may be based on tumor assessment (e.g., evaluation performed between Days 49 and 56 of each cycle and completed before the first dose in the next cycle). Tumor progression or response endpoints may be assessed using RECIST v1.1 criteria for solid tumors.

In certain embodiments in which subjects having NSCLC are treated with an anti-GITR agonist agent, e.g., Ab, as monotherapy or combination therapy, the subjects had progressive or recurrent disease during or after platinum doublet-based chemotherapy; the subjects with non-squamous histology have a known EGFR and ALK status; the subjects with an activating EGFR mutation have received an EGFR tyrosine kinase inhibitor; and/or the subjects with an ALK translocation have received an ALK inhibitor.

In certain embodiments in which subjects having a solid tumor, e.g., advanced solid tumor, such as cervical cancer, are treated with an anti-GITR agonist agent, e.g., Ab, as monotherapy or combination therapy, the subjects have persistent, recurrent or metastatic cervical cancer with documented disease progression; the subject have squamous, adenosquamous or adenocarcinoma histology; the subjects have had one prior systemic chemotherapeutic regimen (e.g. paclitaxel/cisplatin, paclitaxel/cisplatin/bevacizumab) for persistent, recurrent, or metastatic disease; the subjects had chemotherapy administered concurrently with primary radiation (e.g. weekly cisplatin), adjuvant chemotherapy given following completion of radiation therapy or as concurrent chemotherapy and radiation therapy (e.g. paclitaxel and carboplatin for up to 4 cycles); the subjects are HPV positive or negative; the subjects have ECOG performance status of ≤1; the subjects have at least one lesion with measurable disease as defined by RECIST v1.1 for solid tumors and/or the lesion(s) have demonstrated clear progression and can be measured accurately; the subjects had prior exposure to therapy with any agent specifically targeting checkpoint pathway inhibition (such as anti-PD-1, anti-PD-L1, anti-PDL-2, anti-LAG-3, antiCTLA-4 antibody), preferably with a washout period of any time greater than 4 weeks from the last treatment; the subjects experienced prior Grade 1 to 2 checkpoint therapy-related immune-mediated adverse events, which subjects may or not have confirmed recovery from these events at the time of the beginning of the anti-GITR agonist agent, e.g., Ab, therapy, other than endocrinopathies treated with supplementation, as documented by resolution of all related clinical symptoms, abnormal findings on physical examination, and/or associated laboratory abnormalities; and/or subjects had prior ≥Grade 3 checkpoint therapy-related immune adverse events; the subjects had prior therapy with any agent specifically targeting T-cell co-stimulation pathways, such as anti-CD137, anti-OX40 antibody, preferably with a washout period of any time greater than 4 weeks from the last treatment; the subjects had prior palliative radiotherapy that was completed, e.g., at least 2 weeks prior to first dose of the anti-GITR agonist agent, e.g., Ab, therapy; the subjects have symptomatic tumor lesions at baseline; the subjects had palliative radiotherapy within 4 weeks of first dose of the anti-GITR agonist agent, e.g., Ab, therapy; and/or the subjects have adequate organ function for subjects with solid tumor histologies as defined by the following: 1) WBC≥2000/μL (stable off any growth factor within 4 weeks of first administration); 2) Neutrophils≥1500/μL (stable off any growth factor within 4 weeks of first administration); 3) Platelets≥100×103/μL (transfusion to achieve this level is not permitted within 2 weeks of first administration); 4) Hemoglobin≥8.5 g/dL; 5) ALT and AST≤3×ULN; 6) Total bilirubin≤1.5×ULN (except subjects with Gilbert's Syndrome who must have normal direct bilirubin); 7) Normal thyroid function, subclinical hypothyroidism (TSH<10 mIU/mL) or have controlled hypothyroidism on appropriate thyroid supplementation; 8) Serum creatinine≤1.5×ULN or creatinine clearance (CrCl)≥40 ml/min (measured using the Cockcroft-Gault formula below): Female CrCl=(140−age in years)×weight in kg×0.85 72×serum creatinine in mg/dL Male CrCl=(140−age in years)×weight in kg×1.00 72×serum creatinine in mg/dL.

A patient receiving a treatment described herein may be a patient having one or more of the inclusion criteria set forth in Example 1, or not having one or more of the exclusion criteria set forth in Example 1.

In certain embodiments in which subjects having a solid tumor, e.g., advanced solid tumor, such as cervical cancer, are treated with an anti-GITR agonist agent, e.g., Ab, as monotherapy or combination therapy, the subjects have no known or suspected central nervous system (CNS) metastases, untreated CNS metastases, or have the CNS as the only site of disease, except that the subject may have controlled brain metastases (i.e., no radiographic progression for at least 4 weeks following radiation and/or surgical treatment (or 4 weeks of observation if no intervention is clinically indicated), and off of steroids for at least 2 weeks, and no new or progressive neurological signs and symptoms; the subjects have no known carcinomatous meningitis.

In certain embodiments, a method of treatment with an anti-GITR agonist Ab comprises administering the anti-GITR agonist agent, e.g., Ab, into one or more tumors, e.g., solid tumors, of the subject. Administration into a tumor can be via injection into the tumor. In certain embodiments, the anti-GITR agent, e.g., Ab, is administered both parenterally (e.g., intravenously or subcutaneously) and directly into one or more tumors (i.e., intratumorally). Any of the doses recited herein for administering the Ab may be used for intratumoral administration. Alternatively, half of a dose described herein is administered parenterally and half of the dose is administered intratumorally. In certain embodiments, 0.01-10 mg of an anti-GITR agent, e.g., Ab, is administered intratumorally in a subject as a single dose, or alternatively, every week, every 2 weeks, every 3 weeks, or once a month, e.g., until tumor shrinkage. For example, 0.01 mg, 0.05 mg, 0.1 mg, 0.5 mg, 1 mg, 2 mg, 5 mg, 7 mg or 10 mg of an anti-GITR agent, e.g., Ab, is administered intratumorally as a single dose, every week, every 2 weeks, every 3 weeks, or once a month, e.g., until tumor shrinkage. In certain embodiments, lower amounts of the agent, e.g., Ab, may be administered, e.g., 1 μg, 3 μg, 5 μg, 10 μg, 25 μg, 50 μg, or 100 μg.

An anti-PD-1 or PD-L1 antagonist Ab may be co-administered with an anti-GITR agonist agent, e.g., Ab, into one or more tumors in a subject. The anti-PD-1 or PD-L1 Ab may be administered at the same time, before, or after administration of the anti-GITR agent, e.g., Ab. For example, the anti-PD-1 or PD-L1 Ab may be injected into a tumor at the same time as the anti-GITR agent, e.g., Ab, is injected into the tumor. In certain embodiments, the two agents are co-formulated prior to administration into a tumor. In certain embodiments, one agent is administered parenterally and one agent is administered directly into one or more tumors. For example, an anti-PD-1 agent, e.g., Ab, or PD-L1 agent, e.g., Ab, is administered parenterally and an anti-GITR agent, e.g., Ab, is administered intratumorally.

Anti-tumor activity of an anti-GITR agonist agent, e.g., Ab, alone or in combination with an anti-PD-1 or anti-PD-L1 antagonist agent, e.g., Ab, e.g., nivolumab, may be evidenced by an increase in overall survival, e.g., by 1, 2, 3, 4, 5, 6, 7, 8, 9, 10, 11, 12, 16, 24 months or more, relative to a subject treated with a placebo. Efficacy of treatment may be determined by measurement of the objective response rate (ORR). ORR and corresponding 2-sided exact 95% exact confidence interval by the Clopper and Pearson method may be determined. Median duration of response and corresponding two-sided 95% confidence interval may be determined. Duration of response may be analyzed using the Kaplan-Meier method. Progression free survival rate (PFSR), the probability of a subject remaining progression free or surviving to 24 weeks, may be estimated by the Kaplan-Meier methodology. The corresponding 90% confidence interval may be derived based on Greenwood formula. Overall survival may be plotted using the Kaplan-Meier method.

GITR Agonist Agents

A GITR agonist agent is an agent that enhances the activity that normally results from the interaction between GITR and GITRL. In certain embodiments, a GITR agonist agent is an antibody or a variant thereof, such as a multimer thereof, or single chain or antigen binding fragment or bi-specific agent. In certain embodiments, a GITR agonist agent is human GITRL or a variant thereof, such as a fragment thereof, a fusion protein (comprising full length or a GITR binding fragment of GITRL) or a multimer of the full length or a GITR binding fragment of GITRL). Exemplary GITR agonist agents include the following antibodies or multimers thereof or GITRL based molecules: TRX518; MK-4166; MK-1248; Medi 1873; AMG 228; LKZ-145; GWN-323; INCAGN01876; iNBRX-110 (FPA-154); CK-302; OMP-336B11; Regeneron/Sanofi anti-GITR antibody; HERA-GITR-ligands; or a GITR agonist agent described in any one of the following publications: WO06/105021; WO2011/028683; JP2008278814; US20140072566; US20140072565; US20140065152; WO2015/031667; WO/2015/116178; WO2015/184099; WO/2016/054638; WO2016/057841; WO2016/057846; CN105669867; WO/2016/126781; WO/2017/015623; WO/2017/025610; WO/2017/068185; and WO/2017/068186, each of which is specifically incorporated by reference herein.

Anti-GITR Abs

Anti-GITR agonist Abs for use in the methods described herein may be monoclonal antibodies, in particular human monoclonal antibodies that specifically bind GITR and have desirable functional properties, e.g., high affinity binding to human GITR and the ability to stimulate antigen-specific T cell responses. Antigen binding fragments of such Abs may also be used.

In one aspect, anti-GITR agonist Abs, or antigen binding portions thereof, which bind to GITR may exhibit at least one of the following properties:

(a) bind to soluble human GITR;
(b) bind to membrane bound human GITR;
(c) bind to membrane bound cynomolgus GITR;
(d) induce or enhance T cell activation, e.g., antigen specific T cell activation;
(e) inhibit the binding of GITR ligand to GITR on 3A9-hGITR cells;
(f) at most partially inhibits the binding of GITR ligand to GITR on activated T cells;
(g) bind to a conformational epitope on mature human GITR (SEQ ID NO: 4);
(h) bind to both O-linked and N-glycosylated and unglycosylated human GITR;
(i) have agonist activity in the absence of binding to an Fc receptor, but wherein binding to an Fc receptor further enhances the agonist activity; and
(j) compete in either direction or both directions for binding to human GITR with one or more of antibodies 28F3, 3C3-1, 3C3-2, 2G6, 8A6, 9G7-1, 9G7-2, 14E3, 19H8-1, 19H8-2, 19D3, 18E10, and 6G10.

In certain embodiments, the anti-GITR agonist antibodies, or antigen binding portions thereof, described herein stimulate an anti-tumor immune response, for example, an antigen-specific T cell response. In certain embodiments, the anti-GITR agonist antibodies, or antigen binding portions thereof, increase cytokine production (e.g., IL-2 and/or IFN-γ) in GITR-expressing T cells and/or increase T cell proliferation.

In certain embodiments, the anti-GITR agonist antibodies, or antigen binding portions thereof, do not bind to Fc receptors. In certain embodiments, the anti-GITR agonist antibodies, or antigen binding portions thereof, bind to one or more FcγRs, e.g., activating or inhibitory, FcγRs.

In certain embodiments, the anti-GITR agonist antibodies, or antigen binding portions thereof, bind to soluble human GITR with a $K_D$ of 100 nM or less as measured by Biacore, bind to membrane bound human GITR with a $K_D$ of 10 nM or less as measured by Scatchard, bind to membrane bound human GITR with an $EC_{50}$ of 1 nM or less as measured by FACS, bind to membrane bound cynomolgus GITR with an $EC_{50}$ of 10 nM or less as measured by FACS, induce or enhance T cell, e.g, $T_{eff}$ cell, activation without requiring multivalent cross-linking, inhibit the binding of GITR ligand to GITR with an $EC_{50}$ of 1 μg/mL or less as measured by FACS, and/or bind within the regions PTGGPGCGPGRLLLGTGT (SEQ ID NO: 217) and CRDYPGEE (SEQ ID NO: 218) of mature human GITR (SEQ ID NO: 4).

Provided herein are isolated anti-GITR agonist monoclonal antibodies, or antigen binding portions thereof, which specifically bind to GITR and comprise the three variable heavy chain CDRs and the three variable light chain CDRs that are in the variable heavy chain and variable light chain pairs selected from:

(a) SEQ ID NOs: 13 and 14;
(b) SEQ ID NOs: 26 and 27;
(c) SEQ ID NOs: 39 and 40;
(d) SEQ ID NOs: 52 and 53;
(e) SEQ ID NOs: 52 and 54;
(f) SEQ ID NOs: 71 and 72;
(g) SEQ ID NOs: 84 and 85;
(h) SEQ ID NOs: 97 and 98;
(i) SEQ ID NOs: 97 and 99;
(j) SEQ ID NOs: 115 and 116;
(k) SEQ ID NOs: 128 and 129;
(l) SEQ ID NOs: 128 and 130; and
(m) SEQ ID NOs: 335 and 336.

Provided herein are isolated anti-GITR agonist monoclonal antibodies, or antigen binding portions thereof, which bind to GITR and comprise:

(a) heavy chain CDR1, CDR2, and CDR3 sequences comprising SEQ ID NOs: 20, 21, and 22, respectively, and/or light chain CDR1, CDR2, and CDR3 sequences comprising SEQ ID NOs: 23, 24, and 25, respectively;
(b) heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 36, 37, and 38, respectively;
(c) heavy chain CDR1, CDR2, and CDR3 sequences comprising SEQ ID NOs: 46, 47, and 48, respectively, and/or light chain CDR1, CDR2, and CDR3 sequences comprising SEQ ID NOs: 49, 50, and 51, respectively;
(d) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 65, 66, and 67, respectively;
(e) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 68, 69, and 70, respectively;
(f) heavy chain CDR1, CDR2, and CDR3 sequences comprising SEQ ID NOs: 78, 79, and 80, respectively, and/or light chain CDR1, CDR2, and CDR3 sequences comprising SEQ ID NOs: 81, 82, and 83, respectively;

(g) heavy chain CDR1, CDR2, and CDR3 sequences comprising SEQ ID NOs: 91, 92, and 93, respectively, and/or light chain CDR1, CDR2, and CDR3 sequences comprising SEQ ID NOs: 94, 95, and 96, respectively;

(h) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 109, 110, and 111, respectively;

(i) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 112, 113, and 114, respectively;

(j) heavy chain CDR1, CDR2, and CDR3 sequences comprising SEQ ID NOs: 122, 123, and 124, respectively, and/or light chain CDR1, CDR2, and CDR3 sequences comprising SEQ ID NOs: 125, 126, and 127, respectively;

(k) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 141, 142, and 143, respectively;

(l) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 144, 145, and 146, respectively; or (m) heavy chain CDR1, CDR2, and CDR3 sequences comprising SEQ ID NOs: 342, 343, and 344, respectively, and/or light chain CDR1, CDR2, and CDR3 sequences comprising SEQ ID NOs: 345, 346, and 347, respectively.

Provided herein are isolated anti-GITR agonist monoclonal antibodies, or antigen binding portions thereof, which bind to GITR and comprise heavy and light chain variable regions, wherein the heavy chain variable region comprises an amino acid sequence which is at least 90%, 95%, 96%, 97%, 98%, 99%, or 100% identical to the amino acid sequence selected from the group consisting of SEQ ID NOs: 13, 26, 39, 52, 71, 84, 97, 115, 128, and 335.

Provided herein are isolated anti-GITR agonist monoclonal antibodies, or antigen binding portions thereof, which bind to GITR and comprise heavy and light chain variable regions, wherein the light chain variable region comprises an amino acid sequence which is at least 90%, 95%, 96%, 97%, 98%, 99%, or 100% identical to the amino acid sequence selected from the group consisting of SEQ ID NOs: 14, 27, 40, 53, 54, 72, 85, 98, 99, 116, 129, 130, and 336.

Provided herein are isolated anti-GITR agonist antibodies, e.g., monoclonal antibodies, or antigen binding portions thereof, which bind to GITR and comprise heavy and light chain variable region sequences at least 85% identical, for example, 90%, 95%, 96%, 97%, 98%, 99%, or 100% identical, to the amino acid sequences selected from the group consisting of:

(a) SEQ ID NOs: 13 and 14, respectively;
(b) SEQ ID NOs: 26 and 27, respectively;
(c) SEQ ID NOs: 39 and 40, respectively;
(d) SEQ ID NOs: 52 and 53, respectively;
(e) SEQ ID NOs: 52 and 54, respectively;
(f) SEQ ID NOs: 71 and 72, respectively;
(g) SEQ ID NOs: 84 and 85, respectively;
(h) SEQ ID NOs: 97 and 98, respectively;
(i) SEQ ID NOs: 97 and 99, respectively;
(j) SEQ ID NOs: 115 and 116, respectively;
(k) SEQ ID NOs: 128 and 129, respectively;
(l) SEQ ID NOs: 128 and 130, respectively; and
(m) SEQ ID NOs: 335 and 336, respectively.

Provided herein are isolated anti-GITR agonist antibodies, e.g., monoclonal antibodies, or antigen binding portions thereof, which bind to GITR and comprise heavy chain and light chain sequences at least 80%, 85%, 90%, 95%, 96%, 97%, 98% 99%, or 100% identical to the amino acid sequences selected from the group consisting of:

(a) SEQ ID NOs: 15 and 16, respectively;
(b) SEQ ID NOs: 17 and 19, respectively;
(c) SEQ ID NOs: 18 and 19, respectively;
(d) SEQ ID NOs: 28 and 29, respectively;
(e) SEQ ID NOs: 30 and 32, respectively;
(f) SEQ ID NOs: 31 and 32, respectively;
(g) SEQ ID NOs: 41 and 42, respectively;
(h) SEQ ID NOs: 43 and 45, respectively;
(i) SEQ ID NOs: 44 and 45, respectively;
(j) SEQ ID NOs: 55 and 56, respectively;
(k) SEQ ID NOs: 55 and 57, respectively;
(l) SEQ ID NOs: 58 and 60, respectively;
(m) SEQ ID NOs: 59 and 60, respectively;
(n) SEQ ID NOs: 58 and 61, respectively;
(o) SEQ ID NOs: 59 and 61, respectively;
(p) SEQ ID NOs: 73 and 74, respectively;
(q) SEQ ID NOs: 75 and 77, respectively;
(r) SEQ ID NOs: 76 and 77, respectively;
(s) SEQ ID NOs: 86 and 87, respectively;
(t) SEQ ID NOs: 88 and 90, respectively;
(u) SEQ ID NOs: 89 and 90, respectively;
(v) SEQ ID NOs: 102 and 104, respectively;
(w) SEQ ID NOs: 103 and 104, respectively;
(x) SEQ ID NOs: 100 and 101, respectively;
(y) SEQ ID NOs: 100 and 371, respectively;
(z) SEQ ID NOs: 102 and 105, respectively;
(za) SEQ ID NOs: 103 and 105, respectively;
(zb) SEQ ID NOs: 117 and 118, respectively;
(zc) SEQ ID NOs: 119 and 121, respectively;
(zd) SEQ ID NOs: 120 and 121, respectively;
(ze) SEQ ID NOs: 131 and 132, respectively;
(zf) SEQ ID NOs: 134 and 136, respectively;
(zg) SEQ ID NOs: 135 and 136, respectively;
(zh) SEQ ID NOs: 131 and 133, respectively;
(zi) SEQ ID NOs: 134 and 137, respectively;
(zj) SEQ ID NOs: 135 and 137, respectively
(zk) SEQ ID NOs: 337 and 338, respectively;
(zl) SEQ ID NOs: 339 and 341, respectively; and
(zm) SEQ ID NOs: 340 and 341, respectively.

Also provided are anti-GITR agonist antibodies comprising a VHCDR1, VHCDR2, VHCDR3, VLCDR1, VLCDR2, and/or VLCDR3 that differs from the corresponding CDR of 28F3, 3C3-1, 3C3-2, 2G6, 8A6, 9G7-1, 9G7-2, 14E3, 19H8-1, 19H8-2, 19D3, 18E10, and/or 6G10, in 1, 2, 3, 4, 5, 1-2, 1-3, 1-4, or 1-5 amino acid changes (i.e., amino acid substitutions, additions or deletions). In certain embodiments, an anti-GITR antibody comprises 1-5 amino acid changes in each of 1, 2, 3, 4, 5 or 6 of the CDRs relative to the corresponding sequence in 28F3, 3C3-1, 3C3-2, 2G6, 8A6, 9G7-1, 9G7-2, 14E3, 19H8-1, 19H8-2, 19D3, 18E10, and/or 6G10. In certain embodiments, an anti-GITR antibody comprises at total of 1-5 amino acid changes across all CDRs relative to the CDRs in 28F3, 3C3-1, 3C3-2, 2G6, 8A6, 9G7-1, 9G7-2, 14E3, 19H8-1, 19H8-2, 19D3, 18E10, and/or 6G10.

In certain embodiments, an anti-GITR antibody comprises VH and VL CDRs consisting of those of 28F3, wherein one or more of the amino acids in one or more CDRs are those of one of the other anti-GITR agonist antibodies disclosed herein.

For example, in certain embodiments, an anti-GITR agonist antibody comprises a VHCDR1 comprising one or more amino acid modifications relative to SYGMH (SEQ ID NO: 20), and may comprise, e.g., one of the following degenerate sequences:

SYGXH (SEQ ID NO: 372), wherein X is any amino acid, e.g., M or F;

$X_1YGX_2H$, wherein $X_1$ is any amino acid, e.g., S,N or D; and $X_2$ is any amino acid, e.g., M or F; and $X_1YGX_2X_3$, wherein $X_1$ is any amino acid, e.g., S,N or D; $X_2$ is any amino acid, e.g., M or F, and X3 is any amino acid, e.g., H or Q.

In certain embodiments, an anti-GITR agonist antibody comprises a VHCDR2 comprising one or more amino acid modifications relative to VIWYEGSNKYYADSVKG (SEQ ID NO: 21), and may comprise one of the following degenerate sequences:

VIWYX$_1$GSNKX$_2$YADSVKG (SEQ ID NO: 373), wherein $X_1$ is any amino acid, e.g., E or A; and $X_2$ is any amino acid, e.g., Y or F; and VIWYX$_1$GSNKX$_2$YX$_3$DSVKG (SEQ ID NO: 374), wherein $X_1$ is any amino acid, e.g., E, A, G or D; $X_2$ is any amino acid, e.g., Y or F; and $X_3$ is any amino acid, e.g., A or V.

In certain embodiments, an anti-GITR agonist antibody comprises a VHCDR3 comprising one or more amino acid modifications relative to GGSMVRGDYYYGMDV(SEQ ID NO: 22), and may comprise, e.g., one of the following degenerate sequences:

GGSX$_1$VRGDYYYGMDV (SEQ ID NO: 375), wherein $X_1$ is any amino acid, e.g., M or V, L, I or A.

GGSX$_1$VRGX$_2$YYYGMDV (SEQ ID NO: 376), wherein $X_1$ is any amino acid, e.g., M or V, L, I or A; and $X_2$ is any amino acid, e.g., D or E. Particular combinations of $X_1$ and $X_2$ are set forth in the Examples.

GG (6-7aa) MDVWYYX1MDVW (SEQ ID NO: 377), wherein $X_1$ is any amino acid, e.g., G, S or V. In certain embodiments, the 6-7 amino acids correspond to the amino acids at that position in a VHCDR3 sequence of an anti-GITR antibody disclosed herein.

In certain embodiments, an anti-GITR agonist antibody comprises a VLCDR1 comprising one or more amino acid modifications relative to RASQGISSALA (SEQ ID NO: 23), and may comprise, e.g., one of the following degenerate sequences:

RASQGISSXLA (SEQ ID NO: 378), wherein X is any amino acid, e.g., A or W (or A, W or Y); and RASQG (2-3 aa) SX$_1$LA (SEQ ID NO: 379), wherein $X_1$ is any amino acid, e.g., W, Y or A and the 2-3 amino acids are any amino acids, e.g., GI, SVS or SVT.

In certain embodiments, an anti-GITR agonist antibody comprises a VLCDR2 comprising one or more amino acid modifications relative to DASSLES (SEQ ID NO: 24), and may comprise, e.g., one of the following degenerate sequences:

DASSLXS (SEQ ID NO: 380), wherein X is any amino acid, e.g., E or Q; and $X_1ASSX_2X_3X_4$, wherein $X_1$ is any amino acid, e.g., A, D or G; $X_4$ is any amino acid, e.g., L or R; $X_3$ is any amino acid, e.g., Q, E or A; and $X_4$ is any amino acid, e.g., S or T.

In certain embodiments, an anti-GITR agonist antibody comprises a VLCDR3 comprising one or more amino acid modifications relative to QQFNSYPYT (SEQ ID NO: 25), and may comprise, e.g., one of the following degenerate sequences:

QQXNSYPYT (SEQ ID NO: 381), wherein X is any amino acid, e.g., F or Y; and $QQX_1X_2SX_3PX_4T$ (SEQ ID NO: 382), wherein $X_1$ is any amino acid, e.g., F or Y; $X_2$ is any amino acid, e.g., N or G; $X_3$ is any amino acid, e.g., Y or S; and $X_4$ is any amino acid, e.g., Y, W, I, P or Q.

In certain embodiments, the isolated monoclonal antibodies, or antigen binding portions thereof, (a) bind to the same epitope on GITR as 28F3, 19D3, 18E10, 3C3-1, 3C3-2, 2G6, 9G7-1, 9G7-2, 14E3, 19H8-1, 19H8-2 and/or 6G10, and/or (b) inhibit binding of 28F3, 19D3, 18E10, 3C3-1, 3C3-2, 2G6, 9G7-1, 9G7-2, 14E3, 19H8-1, 19H8-2, and/or 6G10 to GITR on activated T cells by at least 50%, 60%, 70%, 80% or 90% as measured by, e.g., FACS.

In certain embodiments, the anti-GITR agonist antibodies, or antigen binding portions thereof, bind within the regions PTGGPGCGPGRLLLGTGT (SEQ ID NO: 217) and CRDYPGEE (SEQ ID NO: 218) of mature human GITR (SEQ ID NO: 4). In some embodiments, the anti-GITR agonist antibodies, or antigen binding portions thereof, described herein, bind to both human and cynomolgus GITR.

In certain embodiments, the anti-GITR agonist antibodies, or antigen-binding portions thereof, are IgG1, IgG2, IgG3, or IgG4 antibodies, or variants thereof. In certain embodiments, the anti-GITR agonist antibodies, or antigen-binding portions thereof, comprise an effectorless IgG1 Fc, for example, an effectorless IgG1 Fc with the following mutations: L234A, L235E, G237A, A330S and P331S. In certain embodiments, the anti-GITR agonist antibodies, or antigen-binding portions thereof, comprise an Fc binding to, or having enhanced binding to, an activating FcγR, e.g., relative to a wild-type IgG1 Fc. In certain embodiments, methionine residues in the CDR regions of the anti-GITR agonist antibodies, or antigen-binding portions thereof, are substituted for amino acid residues that do not undergo oxidation. In certain embodiments, the anti-GITR agonist antibodies, or antigen-binding portions thereof, are human or humanized antibodies.

Anti-GITR agonist antibodies, or antigen binding portions thereof, may comprise a modified heavy chain constant region that comprises an IgG2 hinge and at least one of CH1, CH2 and CH3 that is not of an IgG2 isotype, wherein the anti-GITR agonist antibody has enhanced agonist activity relative to the same anti-GITR antibody but with a non-IgG2 hinge.

In certain embodiments, the modified heavy chain constant region comprises a heavy chain constant region comprising an amino acid sequence selected from the group consisting of SEQ ID NOs: 223-226 and 283-290 or a heavy chain constant region that differs therefrom in at most 5 amino acids or is at least 95%, 96%, 97%, 98% or 99% identical to an amino acid sequence of SEQ ID NOs: 223-226 and 283-290.

In certain embodiments, the heavy chain comprises an amino acid sequence selected from the group consisting of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362, or a heavy chain that differs therefrom in at most 10 amino acids or is at least 95%, 96%, 97%, 98% or 99% identical to an amino acid sequence of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362.

In certain embodiments, the light chain comprises an amino acid sequence selected from the group consisting of SEQ ID NOs: 16, 19, 29, 32, 42, 45, 56, 57, 60, 61, 74, 87, 90, 101, 104, 105, 118, 121, 132, 133, 136, 137, 338, 341, and 371 or a light chain that differs therefrom in at most 10 amino acids or is at least 95%, 96%, 97%, 98% or 99% identical to an amino acid sequence of SEQ ID NOs: 16, 19, 29, 32, 42, 45, 56, 57, 60, 61, 74, 87, 90, 101, 104, 105, 118, 121, 132, 133, 136, 137, 338, 341, and 371.

When referring to % identity or amino acid substitutions in the context of Ab sequences, amino acid substitutions may be conservative amino acid substitutions.

Other anti-GITR agonist antibodies that may be administered as described herein include antibodies comprising the CDR sequences, VH and VL chains or heavy and light chains of (i)

TRX-518 or 6C8, as described, e.g., in WO2006/105021 and Schaer et al. *Curr Opin Immunol*. (2012) April; 24(2): 217-224; (ii) an anti-GITR antibody described in WO2011/028683, e.g., MK4166; an anti-GITR antibody described in JP2008278814; or an anti-GITR antibody described in WO2015/031667.

In other embodiments, an anti-GITR agonist antibody is an antibody that cross-competes with TRX518, MK4166, MK-1248 or an anti-GITR antibody described in WO2015/031667. In some embodiments, an anti-GITR antibody for the present composition binds the same epitope as TRX518, MK4166 or an anti-GITR antibody described in WO2015/031667. In certain embodiments, an anti-GITR agonist antibody comprises six CDRs of TRX518, MK4166, MK-1248 or an anti-GITR antibody described in WO2015/031667.

The heavy chain of an anti-GITR Ab or other Ab described herein may or may not comprise the C-terminal lysine (K), as this amino acid is frequently cleaved off.

Anti-PD-1 and Anti-PD-L1 Abs

An anti-GITR agonist antibody may be administered with an anti-PD1 antibody or an anti-PD-L1 antibody. PD-1 is a key immune checkpoint receptor expressed by activated T and B cells and mediates immunosuppression. PD-1 is a member of the CD28 family of receptors, which includes CD28, CTLA-4, ICOS, PD-1, and BTLA. Two cell surface glycoprotein ligands for PD-1 have been identified, Programmed Death Ligand-1 (PD-L1) and Programmed Death Ligand-2 (PD-L2), that are expressed on antigen-presenting cells as well as many human cancers and have been shown to down regulate T cell activation and cytokine secretion upon binding to PD-1. Inhibition of the PD-1/PD-L1 interaction mediates potent antitumor activity in preclinical models.

HuMAbs that bind specifically to PD-1 with high affinity have been disclosed in U.S. Pat. Nos. 8,008,449 and 8,779,105. Other anti-PD-1 mAbs have been described in, for example, U.S. Pat. Nos. 6,808,710, 7,488,802, 8,168,757 and 8,354,509, and PCT Publication No. WO 2012/145493. Each of the anti-PD-1 HuMAbs disclosed in U.S. Pat. No. 8,008,449 has been demonstrated to exhibit one or more of the following characteristics: (a) binds to human PD-1 with a $K_D$ of $1\times10^{-7}$ M or less, as determined by surface plasmon resonance using a Biacore biosensor system; (b) does not substantially bind to human CD28, CTLA-4 or ICOS; (c) increases T-cell proliferation in a Mixed Lymphocyte Reaction (MLR) assay; (d) increases interferon-γ production in an MLR assay; (e) increases IL-2 secretion in an MLR assay; (f) binds to human PD-1 and cynomolgus monkey PD-1; (g) inhibits the binding of PD-L1 and/or PD-L2 to PD-1; (h) stimulates antigen-specific memory responses; (i) stimulates Ab responses; and (j) inhibits tumor cell growth in vivo. Anti-PD-1 Abs useful for the present invention include mAbs that bind specifically to human PD-1 and exhibit at least one, preferably at least five, of the preceding characteristics.

In one embodiment, the anti-PD-1 Ab is nivolumab. Nivolumab (also known as "OPDIVO®"; formerly designated 5C4, BMS-936558, MDX-1106, or ONO-4538) is a fully human IgG4 (S228P) PD-1 immune checkpoint inhibitor Ab that selectively prevents interaction with PD-1 ligands (PD-L1 and PD-L2), thereby blocking the down-regulation of antitumor T-cell functions (U.S. Pat. No. 8,008,449; Wang et al., 2014 *Cancer Immunol Res*. 2(9): 846-56). Nivolumab can also be referred to as BMS-936558, MDX-1106 ONO-4538, or by its CAS Registry No. 946414-94-4, and is disclosed as antibody 5C4 in WO 2006/121168, incorporated herein by reference in its entirety and for all purposes. Nivolumab is a human monoclonal antibody that specifically binds to PD1 and comprises a light chain variable region provided as SEQ ID NO: 397, and a heavy chain variable region provided as SEQ ID NO: 395. Nivolumab may also be described as an antibody comprising a light chain CDR1 having amino acids 24-34 of SEQ ID NO: 397, a light chain CDR2 having amino acids 50-56 of SEQ ID NO: 397, and a light chain CDR3 having amino acids 89-97 of SEQ ID NO: 397; and comprising a heavy chain CDR1 having amino acids 31-35 of SEQ ID NO: 395, a heavy chain CDR2 having amino acids 50-66 of SEQ ID NO: 395, and a heavy chain CDR3 having amino acids 99-102 of SEQ ID NO: 395. Pharmaceutical compositions of BMS-936558 include all pharmaceutically acceptable compositions comprising BMS-936558 and one or more diluents, vehicles and/or excipients. BMS-936558 may be administered by I. V.

Light chain variable region for Nivolumab:
(SEQ ID NO: 397)
EIVLTQSPATLSLSPGERATLSCRASQSVSSYLAWYQQKPGQAPRLLIY
DASNRATGIPARFSGSGSGTDFTLTISSLEPEDFAVYYCQQSSNWPRTF
GQGTKVEIK Heavy chain variable region for Nivolumab:
(SEQ ID NO: 395)
QVQLVESGGGVVQPGRSLRLDCKASGITFSNSGMHWVRQAPGKGLEWVA
VIWYDGSKRYYADSVKGRFTISRDNSKNTLFLQMNSLRAEDTAVYYCAT
NDDYWGQGTLVTVSS In one embodiment, the anti-PD-1 Ab is pembrolizumab. Pembrolizumab (also known as "KEYTRUDA®", lambrolizumab, and MK-3475) is a humanized monoclonal IgG4 antibody directed against human cell surface receptor PD-1 (programmed death-1 or programmed cell death-1). Pembrolizumab is described, for example, in U.S. Pat. Nos. 8,354,509 and 8,900,587; see also http://www.cancer.gov/drugdictionary?cdrid=695789 (last accessed: Dec. 14, 2014). Pembrolizumab has been approved by the FDA for the treatment of relapsed or refractory melanoma.

In other embodiments, the anti-PD-1 Ab is MEDI0608 (formerly AMP-514), which is a monoclonal antibody. MEDI0608 is described, for example, in U.S. Pat. No. 8,609,089B2 or in http://www.cancer.gov/drugdictionary?cdrid=756047 (last accessed Dec. 14, 2014). In some embodiments, the anti-PD-1 antibody is Pidilizumab (CT-011), which is a humanized monoclonal antibody. Pidilizumab is described in U.S. Pat. No. 8,686,119 B2 or WO 2013/014668 A1. The specificity of CT-011 for PD-1 binding has been questioned.

Anti-PD-1 Abs useful for the disclosed compositions also include isolated Abs that bind specifically to human PD-1 and compete or cross-compete for binding to human PD-1 with nivolumab (see, e.g., U.S. Pat. Nos. 8,008,449 and 8,779,105; WO 2013/173223) or other anti-PD-1 Ab. The ability of Abs to compete or cross-compete for binding to an antigen indicates that these Abs bind to the same or similar epitope region of the antigen and sterically hinder the binding of other competing or cross-competing Abs to that particular epitope region. These competing or cross-competing Abs are expected to have functional properties very similar to those of the antibody that they compete with, e.g., nivolumab, by virtue of their binding to the same or similar epitope region of PD-1. Competing or cross-competing Abs can be readily identified based on their ability to compete or cross-compete, respectively, with nivolumab (or other anti-PD-1 Ab) in standard PD-1 binding assays such as Biacore analysis, ELISA assays or flow cytometry (see, e.g., WO 2013/173223). "Cross-competing" refers to competing in both directions.

In certain embodiments, the Abs that compete or cross-compete for binding to human PD-1 with, or bind to the same or similar epitope region of human PD-1 as, e.g., nivolumab, are mAbs. For administration to human subjects, these competing or cross-competing Abs can be chimeric Abs, or humanized or human Abs. Such chimeric, humanized or human mAbs can be prepared and isolated by methods well known in the art.

Anti-PD-1 Abs useful for the compositions of the disclosed invention also include antigen-binding portions of the above Abs. It has been amply demonstrated that the antigen-binding function of an Ab can be performed by fragments of a full-length Ab. Examples of binding fragments encompassed within the term "antigen-binding portion" of an Ab include (i) a Fab fragment, a monovalent fragment consisting of the $V_L$, $V_H$, $C_L$ and $C_{H1}$ domains; (ii) a F(ab')$_2$ fragment, a bivalent fragment comprising two Fab fragments linked by a disulfide bridge at the hinge region; (iii) a Fd fragment consisting of the $V_H$ and $C_{H1}$ domains; and (iv) a Fv fragment consisting of the $V_L$ and $V_H$ domains of a single arm of an Ab.

Anti-PD-1 Abs suitable for use in the disclosed compositions are Abs that bind to PD-1 with high specificity and affinity, block the binding of PD-L1 and or PD-L2, and inhibit the immunosuppressive effect of the PD-1 signaling pathway. In any of the compositions or methods disclosed herein, an anti-PD-1 "antibody" includes an antigen-binding portion or fragment that binds to the PD-1 receptor and exhibits the functional properties similar to those of whole Abs in inhibiting ligand binding and upregulating the immune system. In certain embodiments, the anti-PD-1 Ab or antigen-binding portion thereof cross-competes with nivolumab for binding to human PD-1. In other embodiments, the anti-PD-1 Ab or antigen-binding portion thereof is a chimeric, humanized or human monoclonal Ab or a portion thereof. In certain embodiments, the Ab is a humanized Ab. In other embodiments, the Ab is a human Ab. Abs of an IgG1, IgG2, IgG3 or IgG4 isotype can be used.

In certain embodiments, the anti-PD-1 Ab or antigen-binding portion thereof comprises a heavy chain constant region which is of a human IgG1 or IgG4 isotype. In certain other embodiments, the sequence of the IgG4 heavy chain constant region of the anti-PD-1 Ab or antigen-binding portion thereof contains an S228P mutation which replaces a serine residue in the hinge region with the proline residue normally found at the corresponding position in IgG1 isotype antibodies. This mutation, which is present in nivolumab, prevents Fab arm exchange with endogenous IgG4 antibodies, while retaining the low affinity for activating Fc receptors associated with wild-type IgG4 antibodies (Wang et al., 2014). In yet other embodiments, the Ab comprises a light chain constant region which is a human kappa or lambda constant region. In other embodiments, the anti-PD-1 Ab or antigen-binding portion thereof is a mAb or an antigen-binding portion thereof. In certain embodiments of any of the therapeutic methods described herein comprising administration of an anti-PD-1 Ab, the anti-PD-1 Ab is nivolumab. In other embodiments, the anti-PD-1 Ab is pembrolizumab. In other embodiments, the anti-PD-1 Ab is chosen from the human antibodies 17D8, 2D3, 4H1, 4A11, 7D3 and 5F4 described in U.S. Pat. No. 8,008,449. In still other embodiments, the anti-PD-1 Ab is MEDI0608 (formerly AMP-514), AMP-224, or Pidilizumab (CT-011).

An exemplary anti-PD-1 antibody is 5C4 comprising heavy and light chains having the sequences shown in SEQ ID NOs: 393 and 394, respectively, or antigen binding fragments and variants thereof. In other embodiments, the antibody comprises the heavy and light chain CDRs or variable regions of 5C4. Accordingly, in one embodiment, the antibody comprises the CDR1, CDR2, and CDR3 domains of the VH of 5C4 having the sequence set forth in SEQ ID NO: 395, and the CDR1, CDR2 and CDR3 domains of the VL of 5C4 having the sequences set forth in SEQ ID NO: 397. In one embodiment, the antibody comprises VH CDR1, CDR2 and CDR3 domains having the sequences set forth in SEQ ID NOs: 399-401, respectively, and VL CDR1, CDR2 and CDR3 domains having the sequences set forth in SEQ ID NOs: 402-404, respectively. In one embodiment, the antibody comprises VH and/or VL regions having the amino acid sequences set forth in SEQ ID NO: 395 and/or SEQ ID NO: 397, respectively. In one embodiment, the antibody comprises the heavy chain variable (VH) and/or light chain variable (VL) regions encoded by the nucleic acid sequences set forth in SEQ ID NO: 396 and/or SEQ ID NO: 398, respectively. In one embodiment, the antibody competes for binding with and/or binds to the same epitope on PD-1 as the above-mentioned antibodies. In one embodiment, the antibody has at least about 90% variable region amino acid sequence identity with the above-mentioned antibodies (e.g., at least about 90%, 95% or 99% variable region identity with SEQ ID NO: 395 or SEQ ID NO: 397).

In certain embodiments, the PD1 antibodies exhibit one or more desirable functional properties, such as high affinity binding to PD-1, e.g., binding to human PD-1 with a $K_D$ of $10^{-7}$ M or less; lack of significant cross-reactivity to other CD28 family members, e.g., CD28, CTLA-4 and ICOS; the ability to stimulate T cell proliferation in a mixed lymphocyte reaction (MLR) assay; the ability to increase IFN-γ and/or IL-2 secretion in an MLR; the ability to inhibit binding of one or more PD-1 ligands (e.g., PD-L1 and/or PD-L2) to PD-1; the ability to stimulate antigen-specific memory responses; the ability to stimulate antibody responses and/or the ability to inhibit growth of tumor cells in vivo.

In certain embodiments, the antibody to be administered with an anti-GITR Ab is an anti-PD-L1 antibody. Because anti-PD-1 and anti-PD-L1 target the same signaling pathway and have been shown in clinical trials to exhibit similar levels of efficacy in a variety of cancers, an anti-PD-L1 Ab can be substituted for the anti-PD-1 Ab in any of the therapeutic methods or compositions disclosed herein. In one embodiment, the anti-PD-L1 antibody is BMS-936559 (formerly 12A4 or MDX-1105) (see, e.g., U.S. Pat. No. 7,943,743; WO 2013/173223), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat.

No. 7,943,743. In certain embodiment an anti-PD-L1 antibody is avelumab, durvalumab (MEDI4736 (also known as Anti-B7-H1)), MPDL3280A (also known as RG7446, atezolizumab and TECENTRIQ), MSB0010718C (WO2013/79174), or rHigM12B7. Any of the anti-PD-L1 antibodies disclosed in WO2013/173223, WO2011/066389, WO2012/145493, U.S. Pat. Nos. 7,635,757 and 8,217,149 and U.S. Publication No. 2009/145493 may also be used. Anti-PD-L1 antibodies that compete with and/or bind to the same epitope as that of any of these antibodies may also be used in the treatments described herein.

An exemplary anti-PD-L1 antibody is 12A4 (WO 2007/005874 and U.S. Pat. No. 7,943,743). In one embodiment, the antibody comprises the heavy and light chain CDRs or VRs of 12A4. Accordingly, in one embodiment, the antibody comprises the CDR1, CDR2, and CDR3 domains of the VH region of 12A4 having the sequence shown in SEQ ID NO: 383 and the CDR1, CDR2 and CDR3 domains of the VL region of 12A4 having the sequence shown in SEQ ID NO: 385. In one embodiment, the antibody comprises the heavy chain CDR1, CDR2 and CDR3 domains having the sequences set forth in SEQ ID NOs: 387-389, respectively, and the light chain CDR1, CDR2 and CDR3 domains having the sequences set forth in SEQ ID NOs: 390-392, respectively. In one embodiment, the antibody comprises VH and/or VL regions having the amino acid sequences set forth in SEQ ID NO: 383 and/or SEQ ID NO: 385, respectively. In one embodiment, the antibody comprises the heavy chain variable (VH) and/or light chain variable (VL) regions encoded by the nucleic acid sequences set forth in SEQ ID NO: 384 and/or SEQ ID NO: 386, respectively. In one embodiment, the antibody competes for binding with, and/or binds to the same epitope on PD-L1 as, the above-mentioned antibodies. In one embodiment, the antibody has at least about 90% variable region amino acid sequence identity with the above-mentioned antibodies (e.g., at least about 90%, 95% or 99% variable region identity with SEQ ID NO: 383 or SEQ ID NO: 385).

Thus, generally, a PD-1/PD-L1 antagonist agent that may be used in the methods described herein include nivolumab, pembrolizumab, atelozilumab, durvalumab, REGN2810, PDR001, AMP-514 (MEDI0608), AMP-224, BGB-A317 or a PD-1 or PD-L1 antagonist described in any one of the following publications: WO 2009/014708, WO 03/099196, WO 2009/114335 and WO 2011/161699.

Compositions

Further provided are compositions, e.g., a pharmaceutical compositions, containing anti-GITR agonist antibodies alone or in combination with antibodies to other targets, e.g., PD-1 or PD-L1, formulated together with a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion).

The pharmaceutical compounds described herein may include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition described herein may also include a pharmaceutically acceptable anti-oxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions described herein include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of presence of microorganisms may be ensured both by sterilization procedures, supra, and by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions described herein is contemplated. A pharmaceutical composition may comprise a preservative or may be devoid of a preservative. Supplementary active compounds can be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated herein. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

In certain embodiments, an anti-GITR agonist agent, e.g., Ab, is coformulated with an anti-PD-1 or PD-L1 antagonist agent, e.g., Ab. An exemplary pharmaceutical composition comprises an anti-PD-1 antibody, e.g., nivolumab (e.g., OPDIVO) or MK-3475 (pembrolizumab; KEYTRUDA), or other PD-1/PD-L1 axis antagonist (e.g., described herein) and an anti-GITR agonist agent (e.g., described herein), e.g., antibody, having the CDRs, variable regions or heavy and light chain sequences of 28F3.IgG1 or 28F3.IgG1.1 or other anti-GITR Ab described herein (e.g., TRX518, MK4166, MK-1248, or an Ab described in a reference cited herein, e.g., in WO2015/031667 or other described herein), wherein the ratio of the amount (e.g., concentration (e.g., mg/ml) or weight) of the anti-PD-1 agent, e.g., antibody, to the amount of the anti-GITR agent, e.g., antibody, (e.g., concentration (e.g., mg/ml) or weight, respectively) is from 1:1-20; 1:1-10; 1:1-5; 1:2-5; 1:2-3; 1:3-5; 1-20:1; 1-10:1; 1-5:1; 2-5:1; 2-3:1; or 3-5:1. The combination may be administered weekly, biweekly, once every three weeks, monthly once every 5 weeks or once every 6 weeks. For example, a flat dose of 10-1000, such as 100-400 mg, e.g., 200-300 mg or 240 mg or 250 mg of an anti-PD-1 agent, e.g., antibody, (e.g., nivolumab) or anti-PD-L1 antagonist agent, e.g., antibody, may be administered together, e.g., as a fixed dose combination, with a flat dose of 3 mg, 10 mg, 30 mg, 100 mg, 120 mg, 200 mg, 240 mg, 250 mg, 300 mg, 400 mg, 480 mg, 500 mg, 600 mg, 700 mg, 800 mg, 900 mg or 1000 mg of an anti-GITR agonist agent, e.g., Ab (e.g., 28F3.IgG1, 28F3.IgG1.1, TRX518, MK4166 or an Ab described in WO2015/031667 or other GITR agonist agent described herein), to a subject having cancer, e.g., advanced solid tumors, e.g., as an intravenous infusion over, e.g., 30, 30-60, 60 or 60-90 minutes every 1, 2, 3, 4, 5 or 6 weeks. In another example, about 3 mg/kg anti-PD-1 agent, e.g., antibody, e.g., nivolumab, may be administered together, e.g., as a fixed dose combination, with 0.1-10 mg/kg, 0.1-5 mg/kg, 0.5-10 mg/kg, 0.5-5 mg/kg, 0.5-2 mg/kg, 1-2 mg/kg or 2-5 mg/kg anti-GITR agent, e.g., antibody, e.g., 28F3.IgG1, 28F3.IgG1.1, TRX518, MK4166, MK-1248 or an Ab described in WO2015/031667 or elsewhere herein, e.g., as an intravenous infusion over, e.g., 30, 30-60, 60 or 60-90 minutes every 1, 2, 3, 4, 5 or 6 weeks. In certain embodiments, 2 mg/kg anti-PD-1 antibody, e.g., MK-3475, is administered together, e.g., as a fixed dose combination, with 0.1-10 mg/kg, 0.1-5 mg/kg, 0.5-10 mg/kg, 0.5-5 mg/kg, 0.5-2 mg/kg, 1-2 mg/kg or 2-5 mg/kg anti-GITR agent, e.g., antibody, e.g., MK4166 or MK-1248, e.g., as an intravenous infusion over, e.g., 30, 30-60 or 60 minutes every 1, 2, 3 or 4 weeks. The amount of antibodies in mg/kg can be calculated to determine the weight (mg) or the concentration (mg/ml) of the antibodies required for a fixed dosing ratio formulation. In certain embodiments, an anti-PD-1 agent, e.g., Ab, and an anti-GITR agent, e.g., Ab, are provided as a lyophilized composition, e.g., in a vial or a dual chamber syringe. A lyophilized composition can comprise, e.g., 50 mg of an anti-PD-1 agent, e.g., Ab, e.g., MK3475, and 5-250 mg, about 10-250, about 30-100 mg, about 30-70 mg or about 50 mg of an anti-GITR agent, e.g., Ab, e.g., 28F3.IgG1, 28F3.IgG1.1, TRX518, MK4166 or an Ab described in WO2015/031667 or other publications cited herein. The combination regimens described in WO/2016/196792 are specifically incorporated by reference herein, and may be applied to a GITR agent and a PD-1/PD-L1 axis antagonist.

Methods of Treatment

Provided herein are methods of treating cancer, e.g., by inhibiting growth of tumors, in a subject, comprising administering to the subject a therapeutically effective amount of an anti-GITR agonist agent, e.g., Ab, described herein, e.g., 28F3.IgG1 or 28F3.IgG1.1, or antigen-binding portion thereof. The antibody may be a human anti-GITR agent, e.g., Ab, (such as any of the human anti-human GITR antibodies described herein). Additionally or alternatively, the antibody can be a chimeric or humanized anti-GITR antibody, e.g., a chimeric or humanized anti-GITR antibody comprising sequences of 28F3 or other anti-GITR antibodies described herein.

Cancers whose growth may be inhibited using the antibodies of the invention include cancers typically responsive to immunotherapy and those that are not typically responsive to immunotherapy. Cancers may be cancers with solid tumors (e.g., advanced solid tumors) or blood malignancies (liquid tumors). Non-limiting examples of cancers for treatment include squamous cell carcinoma, small-cell lung cancer, non-small cell lung cancer, squamous non-small cell lung cancer (NSCLC), non-squamous NSCLC, glioma, gastrointestinal cancer, renal cancer (e.g. clear cell carcinoma), ovarian cancer, liver cancer, colorectal cancer, endometrial cancer, kidney cancer (e.g., renal cell carcinoma (RCC)), prostate cancer (e.g. hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T-cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (M0), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) preferably of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein may also be used for treatment of metastatic cancers, unresectable and/or refractory cancers (e.g., cancers refractory to previous immunotherapy, e.g., with a blocking CTLA-4 or PD-1 antibody), and recurrent cancers. The methods of treatment described herein may also be used to treat a subject who has progressed on an immuno therapy (e.g., immuno stimulating therapy), e.g., an anti-PD1 or anti-PD-L1 treatment.

In certain embodiments, an anti-GITR agent, e.g., Ab, is administered to patients having a cancer that exhibited an inadequate response to a prior treatment, e.g., a prior treatment with an immuno-oncology drug, or patients having a cancer that is refractory or resistant, either intrinsically refractory or resistant (e.g., refractory to a PD-1 pathway antagonist), or a wherein the resistance or refractory state is acquired. For example, subjects who are not responsive or not sufficiently responsive to a first therapy or who see disease progression following treatment, e.g., anti-PD-1 treatment, may be treated by administration of an anti-GITR agent, e.g., Ab, alone or in combination with another therapy (e.g., with an anti-PD-1 therapy).

In certain embodiments, an anti-GITR agent, e.g., Ab, is administered to patients who have not previously received (i.e., been treated with) an immuno-oncology agent, e.g., a PD-1 pathway antagonist (PD-1/PD-L1 axis antagonist or PD-1/PD-L1 antagonist).

An anti-GITR agent, e.g., Ab, and a PD-1/PD-L1 antagonist may be administered with a standard of care treatment. An anti-GITR agent, e.g., Ab, and/or PD-1/PD-L1 antagonist may be administered as a maintenance therapy, e.g., a therapy that is intended to prevent the occurrence or recurrence of tumors.

An anti-GITR agent, e.g., Ab, and a PD-1/PD-L1 antagonist may be administered with another treatment, e.g., radiation, surgery, or chemotherapy. An anti-GITR agent, e.g., Ab, a PD-1/PD-L1 antagonist adjunctive therapy may be administered when there is a risk that micrometastases may be present and/or in order to reduce the risk of a relapse.

Based at least on the finding that subjects treated with an GITR agonist agent and a PD-1/PD-L1 axis antagonist have an increased peripheral blood level (or number) of (1) proliferating CD8+ cells; (2) proliferating and activated CD4+ and CD8+ effector memory and central memory T cells and (3) proliferating NK cells 8 days after administration of a dose of the GITR agonist and the PD-1/PD-L1 axis antagonist, provided herein are methods for treating subjects having cancer with an immunostimulating therapy (e.g., GITR agonist and PD-1/PD-L1 antagonist), wherein the treatment increases the level or number of one or more of these populations of cells. In certain embodiment, administration of a single dose of the immunostimulating agent induces an elevation of the level of one or more of these cell populations by at least 1.5, 2, 3, 4 or 5 fold relative to their base level, e.g., level immediately prior to (e.g., less than 10, 5, 4, 3, 2, or 1 hour prior to) administration of the first dose of the therapy. Measurement of the level of these cell types in the peripheral blood of a subject can be done as described in the Examples. Accordingly, provided herein are methods of treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (1) proliferating CD8+ cells; (2) proliferating and activated CD4+ and CD8+effector memory and central memory T cells and/or (3) proliferating NK cells is higher by, e.g., 1.5 fold, 2, 3, 4 or 5 fold relative the level of the cell population before the administration. In certain embodiments, methods of treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (1) proliferating CD8+ cells; (2) proliferating and activated CD4+ and CD8+ effector memory and central memory T cells and (3) proliferating NK cells is higher by, e.g., 1.5 fold, 2, 3, 4 or 5 fold relative the level of the cell population before the administration. A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (i) proliferating CD8+effector memory cells; (ii) activated CD8+ effector memory cells; (iii) proliferating CD8+ central memory cells; and (iv) activated CD8+ central memory cells is higher by, e.g., 1.5 fold, 2, 3, 4 or 5 fold relative the level of the cell population before the administration. A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (i) proliferating CD4+ effector memory cells; (ii) activated CD4+ effector memory cells; (iii) proliferating CD4+ central memory cells; and (iv) activated CD4+ central memory cells is higher by, e.g., 1.5 fold, 2, 3, 4 or 5 fold relative the level of the cell population before the administration. A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (i) proliferating CD8+effector memory cells; (ii) activated CD8+ effector memory cells; (iii) proliferating CD8+ central memory cells; (iv) activated CD8+ central memory cells; (v) proliferating CD4+ effector memory cells; (vi) activated CD4+ effector memory cells; (vii) proliferating CD4+ central memory cells; and (viii) activated CD4+central memory cells is higher by, e.g., 1.5 fold, 2, 3, 4 or 5 fold relative the level of the cell population before the administration.

A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of any one of (i) proliferating CD4+ central memory cells; (ii) proliferating CD8+ central memory cells; (iii) activated CD4+ central memory cells and (iv) activated CD8+ central memory cells, is higher by, e.g., 1.5 fold, 2, 3, 4 or 5 fold relative the level of the cell population before the administration.

A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (i) proliferating CD4+ central memory cells; (ii) proliferating CD8+ central memory cells; (iii) activated CD4+ central memory cells and (iv) activated CD8+ central memory cells, is higher by, e.g., 1.5 fold, 2, 3, 4 or 5 fold relative the level of the cell population before the administration.

A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of any one of (i) proliferating CD4+ effector memory cells; (ii) proliferating CD8+ effector memory cells; (iii) activated CD4+ effector memory cells and (iv) activated CD8+ effector memory cells, is higher by, e.g., 1.5 fold, 2, 3, 4 or 5 fold relative the level of the cell population before the administration.

A method may comprise treating a subject having cancer with an immunostimulating therapy (e.g., an immuno-oncology drug, e.g., an PD-1/PD-L1 axis antagonist alone, or together with one or more immunostimulating agents, e.g., a GITR agonist agent), comprising administering to the subject a first dose of the immunostimulating therapy, wherein at about 5-12 days (e.g., 8 days) following the administration, the level (or number) of (i) proliferating CD4+ effector memory cells; (ii) proliferating CD8+ effector memory cells; (iii) activated CD4+ effector memory cells and (iv) activated CD8+ effector memory cells, is higher by, e.g., 1.5 fold, 2, 3, 4 or 5 fold relative the level of the cell population before the administration.

In any of these embodiments, proliferating CD4 effector memory cells are CD45+CD3+CD4+CD8-CD197-CD45RA-Ki67+ T cells (CD197 is CCR7); activated CD4 effector memory cells are CD45+CD3+CD4+CD8-CD197-CD45RA-HLA-DR+; proliferating CD4 central memory cells are CD45+CD3+CD4+CD8-CD197+CD45RA-Ki67+; and activated CD4 central memory cells are CD45+CD3+CD4+CD8-CD197+CD45RA-HLA-DR+; proliferating CD8 effector memory cells are CD45+CD3+CD4-CD8+CD197-CD45RA-Ki67+ cells; activated CD8 effector memory cells are CD45+CD3+CD4-CD8+CD197-CD45RA-HLA-DR+; proliferating CD8 central memory cells are CD45+CD3+CD4-CD8+CD197+CD45RA-Ki67+; and activated CD8 central memory cells are CD45+CD3+CD4-CD8+CD197+CD45RA-HLA-DR+, and the level of these cells is determined by flow cytometry, as described, e.g., in the Examples.

In certain embodiments, a dose, e.g., a first dose, of the immunostimulating therapy (e.g., GITR agonist agent and PD-1/PD-L1 antagonist agent) is administered to a subject having cancer, resulting in an elevation of the number of one or more populations of cells selected from (1) proliferating CD8+ cells; (2) proliferating and activated CD4+ and CD8+ effector memory and central memory T cells and (3) proliferating NK cells; and a second dose of the immunostimulating therapy is administered at a time when the proliferation or activation of one or more of these populations of cells, e.g., peripheral effector memory T cells and/or central memory T cells, are at or close to their respective baseline level that was present in the subject immediately prior to administration of the dose, e.g., first dose, of the immunostimulating therapy. In certain methods, a dose, e.g., a first dose, of an immunostimulating therapy (e.g., GITR agonist agent and PD-1/PD-L1 antagonist agent) is administered to a subject having cancer, resulting in an elevation of the level (or number) of (i) proliferating CD8+ effector memory cells; (ii) activated CD8+ effector memory cells; (iii) activated CD8+ effector memory cells; and/or (iv) activated CD8+ effector memory cells is higher by, e.g., 1.5 fold, 2, 3, 4 or 5 fold relative the level of the cell population before the administration; and a second dose of the immunostimulating therapy is administered at a time when the level (or number) of (i) proliferating CD8+ effector memory cells; (ii) activated CD8+ effector memory cells; (iii) proliferating CD8+ central memory cells; and/or (iv) activated CD8+ central memory cells are at or close (e.g., within 2 fold) to their respective baseline level that was present in the subject immediately prior to administration of the dose, e.g., first dose, of the immunostimulating therapy. In certain methods, a dose, e.g., a first dose, of an immunostimulating therapy (e.g., GITR agonist agent and PD-1/PD-L1 antagonist agent) is administered to a subject having cancer, resulting in an elevation of the level (or number) of (i) proliferating CD4+ effector memory cells; (ii) activated CD4+ effector memory cells; (iii) proliferating CD4+ central memory cells; and/or (iv) activated CD4+central memory cells is higher by, e.g., 1.5 fold, 2, 3, 4 or 5 fold relative the level of the cell population before the administration; and a second dose of the immunostimulating therapy is administered at a time when the level (or number) of (i) proliferating CD4+ effector memory cells; (ii) activated CD4+ effector memory cells; (iii) prolferating CD4+ central memory cells; and/or (iv) activated CD4+ central memory cells are at or close to (e.g., within 2 fold) their respective baseline level that was present in the subject immediately prior to administration of the dose, e.g., first dose, of the immunostimulating therapy. In certain methods, a dose, e.g., a first dose, of an immunostimulating therapy (e.g., GITR agonist agent and PD-1/PD-L1 antagonist agent) is administered to a subject having cancer, resulting in an elevation of the level (or number) of (i) proliferating CD8+ effector memory cells; (ii) activated CD8+ effector memory cells; (iii) proliferating CD8+ central memory cells; (iv) activated CD8+ central memory cells; (v) proliferating CD4+ effector memory cells; (vi) activated CD4+ effector memory cells; (vii) proliferating CD4+ central memory cells; and/or (viii) activated CD4+ central memory cells is higher by, e.g., 1.5 fold, 2, 3, 4 or 5 fold relative the level of the cell population before the administration; and a second dose of the immunostimulating therapy is administered at a time when the level (or number) of (i) proliferating CD8+ effector memory cells; (ii) activated CD8+ effector memory cells; (iii) proliferating CD8+ central memory cells; (iv) activated CD8+ central memory cells; (v) proliferating CD4+ effector memory cells; (vi) activated CD4+ effector memory cells; (vii) proliferating CD4+ central memory cells; and/or (viii) activated CD4+ central memory cells are at or close to (e.g., within 2 fold) their respective baseline level that was present in the subject immediately prior to administration of the dose, e.g., first dose, of the immunostimulating therapy. The subsequent doses may be administered at about the same time interval as that between the first and the second doses. In any of these embodiments, proliferating CD4 effector memory cells are CD45+CD3+CD4+CD8-CD197-CD45RA-Ki67+ T cells (CD197 is CCR7); activated CD4 effector memory cells are CD45+CD3+CD4+CD8-CD197-CD45RA-HLA-DR+; proliferating CD4 central memory cells are CD45+CD3+CD4+CD8-CD197+CD45RA-Ki67+; and activated CD4 central memory cells are CD45+CD3+CD4+CD8-CD197+CD45RA-HLA-DR+; proliferating CD8 effector memory cells are CD45+CD3+CD4-CD8+CD197-CD45RA-Ki67+ cells; activated CD8 effector memory cells are CD45+CD3+CD4-CD8+CD197-CD45RA-HLA-DR+; proliferating CD8 central memory cells are CD45+CD3+CD4-CD8+CD197+CD45RA-Ki67+; and activated CD8 central memory cells are CD45+CD3+CD4-CD8+CD197+CD45RA-HLA-DR+, and the level of these cells is determined by flow cytometry, as described, e.g., in the Examples.

Also provided are methods for determining whether a subject is likely to respond to a given immunostimulating therapy, e.g., responding by the stabilization or shrinkage of the tumors. In one embodiment, a method comprises administering to a subject a dose of immunostimulating therapy (e.g., a GITR agonist agent and a PD-1/PD-L1 axis antagonist), and determining about 3-12 days later the level of one or one or more populations of cells selected from (1) proliferating CD8+ cells; (2) proliferating and activated CD4+ and CD8+ effector memory and central memory T cells and (3) proliferating NK cells, wherein an increase (by, 1.5, 2, 3, 4, or 5 or more fold) in one or more of these populations of cells relative to their respective level before administration of the therapy, indicates that the subject is likely to respond to the therapy, whereas the lack of increase in one or more of these cell populations indicates that the subject is not likely to respond to the treatment. A method may comprise administering to a subject a dose of immunostimulating therapy (e.g., a GITR agonist agent and a PD-1/PD-L1 axis antagonist), and determining about 3-12 days later the level of (i) proliferating CD8+ effector memory cells; (ii) activated CD8+ effector memory cells; (iii) proliferating CD8+central memory cells; and/or (iv) activated CD8+ central memory cells, wherein an increase (by, 1.5, 2, 3, 4, or 5 or more fold) in one or more (e.g., all) of these populations of cells relative to their respective level before administration of the therapy, indicates that the subject is likely to respond to the therapy, whereas the lack of increase in one or more (or all) of these cell populations indicates that the subject is not likely to respond to the treatment. A method may comprise administering to a subject a dose of immunostimulating therapy (e.g., a GITR agonist agent and a PD-1/PD-L1 axis antagonist), and determining about 3-12 days later the level of (i) proliferating CD4+ effector memory cells; (ii) activated CD4+ effector memory cells; (iii) proliferating CD4+ central memory cells; (iv) activated CD4+ central memory cells, wherein an increase (by, 1.5, 2, 3, 4, or 5 or more fold) in one or more (e.g., all) of these populations of cells relative to their respective level before administration of the therapy, indicates that the subject is likely to respond to the therapy, whereas the lack of increase in one or more (or all) of these cell populations indicates that the subject is not likely to respond to the treatment. A method may comprise administering to a subject a dose of immunostimulating therapy (e.g., a GITR agonist agent and a PD-1/PD-L1 axis antagonist), and determining about 3-12 days later the level of (i) proliferating CD8+ effector memory cells; (ii) activated CD8+ effector memory cells; (iii) proliferating CD8+ central memory cells; (iv) activated CD8+ central memory cells; (v) proliferating CD4+ effector memory cells; (vi) activated CD4+ effector memory cells; (vii) proliferating CD4+ central memory cells; and (viii) activated CD4+ central memory cells, wherein an increase (by, 1.5, 2, 3, 4, or 5 or more fold) in one or more (e.g., all) of these populations of cells relative to their respective level before administration of the therapy, indicates that the subject is likely to respond to the therapy, whereas the lack of increase in one or more (or all) of these cell populations indicates that the subject is not likely to respond to the treatment. In any of these embodiments, proliferating CD4 effector memory cells are CD45+CD3+CD4+CD8-CD197-CD45RA-Ki67+ T cells (CD197 is CCR7); activated CD4 effector memory cells are CD45+CD3+CD4+CD8-CD197-CD45RA-HLA-DR+; proliferating CD4 central memory cells are CD45+CD3+CD4+CD8-CD197+CD45RA-Ki67+; and activated CD4 central memory cells are CD45+CD3+CD4+CD8-CD197+CD45RA-HLA-DR+; proliferating CD8 effector memory cells are CD45+CD3+CD4-CD8+CD197-CD45RA-Ki67+ cells; activated CD8 effector memory cells are CD45+CD3+CD4-CD8+CD197-CD45RA-HLA-DR+; proliferating CD8 central memory cells are CD45+CD3+CD4-CD8+CD197+CD45RA-Ki67+; and activated CD8 central memory cells are CD45+CD3+CD4-CD8+CD197+CD45RA-HLA-DR+, and the level of these cells is determined by flow cytometry, as described, e.g., in the Examples.

Kits

Also within the scope of the present invention are kits comprising an anti-GITR agonist agent, e.g., Ab, and optionally an anti-PD-1 or anti-PD-L1 antagonist agent, e.g., Ab, compositions and instructions for therapeutic uses. Kits typically include a label indicating the intended use of the contents of the kit and instructions for use. The term label includes any writing, or recorded material supplied on or with the kit, or which otherwise accompanies the kit. Accordingly, this disclosure provides a kit comprising: (a) an appropriate dosage of one or more compositions disclosed herein (e.g., an anti-GITR agonist agent, e.g., Ab, composition alone or with an anti-PD-1 or anti-PD-L1 antagonist composition or a composition comprising the two Abs) and (b) instructions for using the composition(s) in any of the methods disclosed herein.

Exemplary Embodiments:

1. A method of treating a subject having cancer, comprising administering to a subject having cancer an anti-GITR agonist antibody (Ab) at a flat dose ranging from 1-800 mg once every 2-4 weeks.
2. The method of embodiment 1, wherein the anti-GITR agonist antibody is administered once every 2 weeks.
3. The method of embodiment 1, wherein the anti-GITR agonist antibody is administered once every 3 weeks.
4. The method of any one of embodiments 1-3, wherein the anti-GITR agonist antibody is administered at a flat dose ranging from 10-800 mg.
5. The method of embodiment 4, wherein the anti-GITR agonist antibody is administered at a flat dose ranging from 100-500 mg.
6. The method of any one of embodiments 1-5, wherein the anti-GITR agonist antibody is administered at a flat dose ranging from 100-500 mg once every 2-3 weeks.
7. The method of any one of embodiments 1-6, wherein the anti-GITR agonist antibody is administered for 1-5 cycles, wherein each cycle is 8 weeks long.
8. The method of embodiment 7, wherein the anti-GITR agonist antibody is administered for 3 cycles.
9. The method of any one of embodiments 1-8, wherein the cancer is a solid tumor cancer.
10. The method of any one of embodiments 1-8, wherein the cancer is an advanced cancer.
11. The method of embodiment 9, wherein the cancer is an advanced solid tumor cancer.
12. The method of any one of embodiments 1-8, wherein the cancer is a hematopoietic cancer.
13. The method of any one of embodiments 1-12, wherein the cancer comprises tumors expressing higher than normal GITR levels.
14. The method of embodiment 13, wherein the cancer comprises tumors having high levels of GITR positive Treg/Teff infiltration.
15. The method of any one of embodiments 1-14, wherein the GITR agonist antibody is administered as a monotherapy.
16. The method of any one of embodiments 1-14, wherein the GITR agonist antibody is administered as part of a combination therapy.
17. The method of embodiment 16, wherein the combination therapy is a fixed dose combination therapy.
18. The method of embodiment 16, wherein the combination therapy comprises administering an immuno-oncology agent other than the anti-GITR agonist Ab.
19. The method of embodiment 18, wherein the immuno-oncology agent is an anti-PD1 or anti-PD-L1 antagonist agent.
20. The method of embodiment 19, wherein the anti-PD1 or anti-PD-L1 antagonist agent is an antibody.
21. The method of embodiment 19 or 20, wherein the anti-PD1 or anti-PD-L1 antagonist agent is administered prior to administration of the anti-GITR agonist antibody.
22. The method of embodiment 21, wherein the anti-GITR agonist antibody and the anti-PD-1 or anti-PD-L1 antagonist agent are administered intravenously by infusion.
23. The method of embodiment 22, wherein the infusion of the anti-GITR agonist antibody is initiated 10-120 minutes after the termination of the infusion of the anti-PD1 or anti-PD-L1 antagonist agent.
24. The method of embodiment 23, wherein the infusion of the anti-GITR agonist antibody is initiated 30-60 minutes after the termination of the infusion of the anti-PD1 or anti-PD-L1 antagonist agent.
25. The method of embodiment 24, wherein the cancer is lung cancer or cervical cancer.
26. The method of embodiment 23, wherein the anti-GITR agonist antibody and the anti-PD-1 or anti-PD-L1 antagonist antibody are co-infused.
27. The method of any one of embodiments 1-26, wherein the subject has not been previously treated with an immuno-oncology agent.
28. The method of embodiment 27, wherein the subject has not been previously treated with an immuno-oncology agent within a year.
29. The method of any one of embodiments 1-26 and 28, wherein the subject is not responsive or is resistant to another immuno-oncology agent therapy.
30. The method of embodiment 29, wherein the other immuno-oncology agent therapy is a PD-1 or PD-L1 antagonist therapy.
31. The method of any one of embodiments 1-30, wherein the anti-GITR agonist Ab comprises the VH CDR1, CDR2, CDR3 and VL CDR1, CDR2, CDR3 of 28F3.IgG1.
32. The method of any one of embodiments 1-31, wherein the anti-GITR agonist Ab comprises a VH and VL chain that is at least 95%, 96%, 97%, 98% 99% or 100% identical to the VH and VL sequences of 28F3.IgG1, respectively.
33. The method of any one of embodiments 1-32, wherein the anti-GITR agonist Ab comprises a heavy chain (optionally without the C-terminal lysine of the heavy chain) and a light chain that are at least 95%, 96%, 97%, 98%

99% or 100% identical to the heavy and light chain sequences of 28F3.IgG1, respectively.
34. The method of any one of embodiments 1-33, which when it is a combination therapy, is administered with an anti-PD-1 Ab comprising the VH CDR1, CDR2, CDR3 and VL CDR1, CDR2, CDR3 of nivolumab.
35. The method of embodiment 34, wherein the anti-PD-1Ab comprises a VH and VL chain that is at least 95%, 96%, 97%, 98% 99% or 100% identical to the VH and VL sequences of nivolumab, respectively.
36. The method of embodiment 35, wherein the anti-PD-1Ab comprises a heavy chain (optionally without the C-terminal lysine of the heavy chain) and a light chain that are at least 95%, 96%, 97%, 98% 99% or 100% identical to the heavy and light chain sequences of nivolumab, respectively.
37. The method of any one of embodiments 1-33, which when it is a combination therapy, is administered with an anti-PD-L1 Ab comprising the VH CDR1, CDR2, CDR3 and VL CDR1, CDR2, CDR3 of 12A4.
38. The method of embodiment 34, wherein the anti-PD-L1 Ab comprises a VH and VL chain that is at least 95%, 96%, 97%, 98% 99% or 100% identical to the VH and VL sequences of 12A4, respectively.
39. The method of embodiment 35, wherein the anti-PD-L1 Ab comprises a heavy chain (optionally without the C-terminal lysine of the heavy chain) and a light chain that are at least 95%, 96%, 97%, 98% 99% or 100% identical to the heavy and light chain sequences of 12A4, respectively.
40. The method of any one of embodiments 1-39, wherein the subject has previously been treated for the same disease with a different therapeutic agent.
41. The method of embodiment 40, wherein the different therapeutic agent is not an immuno-oncology agent.

TABLE 2

SEQUENCES

| SEQ ID | Description | Sequence |
|---|---|---|
| 1 | Human GITR isoform 1 | MAQHGAMGAFRALCGLALLCALSLGQRPTGGPGCGPGR LLLGTGTDARCCRVHTTRCCRDYPGEECCSEWDCMCVQ PEFHCGDPCCTTCRHHPCPPGQGVQSQGKFSFGFQCID CASGTFSGGHEGHCKPWTDCTQFGFLTVFPGNKTHNAV CVPGSPPAEPLGWLTVVLLAVAACVLLLTSAQLGLHIW QLRSQCMWPRETQLLLEVPPSTEDARSCQFPEEERGER SAEEKGRLGDLWV |
| 2 | Human GITR isoform 2 | MAQHGAMGAFRALCGLALLCALSLGQRPTGGPGCGPGR LLLGTGTDARCCRVHTTRCCRDYPGEECCSEWDCMCVQ PEFHCGDPCCTTCRHHPCPPGQGVQSQGKFSFGFQCID CASGTFSGGHEGHCKPWTDCCWRCRRRPKTPEAASSPR KSGASDRQRRGGWETCGCEPGRPPGPPTAASPSPGAP QAAGALRSALGRALLPWQQKWVQEGGSDQRPGPCSSAA AAGPCRRERETQSWPPSSLAGPDGVGS |
| 3 | Human GITR isoform 3 | MAQHGAMGAFRALCGLALLCALSLGQRPTGGPGCGPGR LLLGTGTDARCCRVHTTRCCRDYPGEECCSEWDCMCVQ PEFHCGDPCCTTCRHHPCPPGQGVQSQGKFSFGFQCID CASGTFSGGHEGHCKPWTDCTQFGFLTVFPGNKTHNAV CVPGSPPAEPLGWLTVVLLAVAACVLLLTSAQLGLHIW QLRKTQLLLEVPPSTEDARSCQFPEEERGERSAEEKGR LGDLWV |
| 4 | Human GITR (mature) | QRPTGGPGCGPGRLLLGTGTDARCCRVHTTRCCRDYPG EECCSEWDCMCVQPEFHCGDPCCTTCRHHPCPPGQGVQ SQGKFSFGFQCIDCASGTFSGGHEGHCKPWTDCTQFGF LTVFPGNKTHNAVCVPGSPPAEP |
| 5 | Cynomolgus GITR | MCASGTLCCLALLCAASLGQRPTGGPGCGPGRLLLGTG KDARCCRVHPTRCCRDYQGEECCSEWDCVCVQPEFHCG NPCCTTCQHHPCPSGQGVQPQGKFSFGFRCVDCALGTF SRGHDGHCKPWTDCTQFGFLTVFPGNKTHNAVCVPGSP PAEPPGWLTIILLAVAACVLLLTSAQLGLHIWQLRSQP TGPRETQLLLEVPPSTEDASSCQFPEEERGERLAEEKG RLGDLWV |
| 6 | Human GITR-L | MTLHPSPITCEFLFSTALISPKMCLSHLENMPLSHSRT QGAQRSSWKLWLFCSIVMLLFLCSFSWLIFIFLQLETA KEPCMAKFGPLPSKWQMASSEPPCVNKVSDWKLEILQN GLYLIYGQVAPNANYNDVAPFEVRLYKNKDMIQTLTNK SKIQNVGGTYELHVGDTIDLIFNSEHQVLKNNTYWGII LLANPQFIS |
| 7 | Human IgG1 constant domain | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKRVEPKSCDKTHTCPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE |

TABLE 2-continued

SEQUENCES

| SEQ ID | Description | Sequence |
|---|---|---|
|  |  | PQVYTLPPSR<u>EEM</u>TKNQVSLTCLVKGFYPSDIAVEWES NGQPENNYKTTPPVLDSDGSFFLYSKLTVDKSRWQQGN VFSCSVMHEALHNHYTQKSLSLSPG |
| 8 | Human IgG1 constant domain (allotypic variant) | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDK<u>K</u>VEPKSCDKTHTCPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE PQVYTLPPSR<u>DEL</u>TKNQVSLTCLVKGFYPSDIAVEWES NGQPENNYKTTPPVLDSDGSFFLYSKLTVDKSRWQQGN VFSCSVMHEALHNHYTQKSLSLSPG |
| 9 | Human IgG1 constant domain with L234A, L235E, and G237A mutations | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDK<u>R</u>VEPKSCDKTHTCPPCPA PE<u>AEGA</u>PSVFLF PPKPKDTLMISRTPEVTCVVVDVSHEDPEVKFNWYVDG VE VHNAKTKPREEQYNSTYRVVSVLTVLHQDWLNGKEYKC KV SNKALPAPIEKTISKAKGQPREPQVYTLPPSR<u>EEM</u>TKN QVSLTCLVKGFYPSDIAVEWESNGQPENNYKTTPPVLD SDGSFFLYSKLTVDKSRWQQGNVFSCSVMHEALHNHYT QKSLSLSPG |
| 10 | Human IgG1 constant domain with A330S and P331S mutations | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDK<u>R</u>VEPKSCDKTHTCPPCPA PELLGGPSVFLF PPKPKDTLMISRTPEVTCVVVDVSHEDPEVKFNWYVDG VE VHNAKTKPREEQYNSTYRVVSVLTVLHQDWLNGKEYKC KV SNKALP<u>SS</u>IEKTISKAKGQPREPQVYTLPPSR<u>EEM</u>TKN QVSLTCLVKGFYPSDIAVEWESNGQPENNYKTTPPVLD SDGSFFLYSKLTVDKSRWQQGNVFSCSVMHEALHNHYT QKSLSLSPG |
| 11 | Human IgG1.1 constant domain (L234A, L235E, G237A, A330S, and P331S mutations) | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKRVEPKSCDKTHTCPPCPA PE<u>AEGA</u>PSVFLFPPKPKDTLMISRTPEVTCVVVDVSHE DPEVKFNWYVDGVEVHNAKTKPREEQYNSTYRVVSVLT VLHQDWLNGKEYKCKVSNKALP<u>SS</u>IEKTISKAKGQPRE PQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPG |
| 12 | Human IgG1 kappa light chain constant region (CL) | RTVAAPSVFIFPPSDEQLKSGTASVVCLLNNFYPREAKVQWKVDNA LQSGNSQESVTEQDSKDSTYSLSSTLTLSKADYEKHKVYACEVTHQ GLSSPVTKSFNRGEC |
| 13 | 28F3 (VH) | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSS |
| 14 | 28F3 (VL) | AIQLTQSPSSLSASVGDRVTITCRASQGISSALAWYQQ KPGKAPKLLIYDASSLESGVPSRFSGSGSGTDFTLTIS SLQPEDFATYYCQQFNSYPYTFGQGTKLEIK |
| 15 | 28F3 (full length wild-type heavy chain) The constant region is underlined | QVQLVESGGGVVQPGRSLRLSCAASGFTFSSYGMHWVRQAPGKGLE WVAVIWYEGSNKYYADSVKGRFTISRDNSKNTLYLQMNSLRAEDTA VYYCARGGSMVRGDYYYGMDVWGQGTTVTVSS<u>ASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPGK</u> |

TABLE 2-continued

SEQUENCES

| SEQ ID | Description | Sequence |
|---|---|---|
| 16 | 28F3 (full length wild-type light chain) The constant region is underlined | AIQLTQSPSSLSASVGDRVTITCRASQGISSALAWYQQKPGKAPKL LIYDASSLESGVPSRFSGSGSGTDFTLTISSLQPEDFATYYCQQFN SYPYTFGQGTKLEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 17 | 28F3.IgG1 (VH + IgG1) | QVQLVESGGGVVQPGRSLRLSCAASGFTFSSYGMHWVRQAPGKGLE WVAVIWYEGSNKYYADSVKGRFTISRDNSKNTLYLQMNSLRAEDTA VYYCARGGSMVRGDYYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPELLGGPSVFLFPPKPKDTLMISRTPEVTCVVVDVSHE DPEVKFNWYVDGVEVHNAKTKPREEQYNSTYRVVSVLTVLHQDWLN GKEYKCKVSNKALPAPIEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 18 | 28F3.IgG1.1 (VH + IgG1.1) | QVQLVESGGGVVQPGRSLRLSCAASGFTFSSYGMHWVRQAPGKGLE WVAVIWYEGSNKYYADSVKGRFTISRDNSKNTLYLQMNSLRAEDTA VYYCARGGSMVRGDYYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEAEGAPSVFLFPPKPKDTLMISRTPEVTCVVVDVSHE DPEVKFNWYVDGVEVHNAKTKPREEQYNSTYRVVSVLTVLHQDWLN GKEYKCKVSNKALPSSIEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 19 | 28F3.IgG1 (VL + CL) | AIQLTQSPSSLSASVGDRVTITCRASQGISSALAWYQQKPGKAPKL LIYDASSLESGVPSRFSGSGSGTDFTLTISSLQPEDFATYYCQQFN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 20 | 28F3 VH CDR1 | SYGMH |
| 21 | 28F3 VH CDR2 | VIWYEGSNKYYADSVKG |
| 22 | 28F3 VH CDR3 | GGSMVRGDYYYGMDV |
| 23 | 28F3 VL CDR1 | RASQGISSALA |
| 24 | 28F3 VL CDR2 | DASSLES |
| 25 | 28F3 VL CDR3 | QQFNSYPYT |
| 26 | 19D3 (VH) | QVQLVESGGGVVQPGRSLRLSCAASGFTFSSYGFHWVR QAPGKGLEWVAVIWYAGSNKFYADSVKGRFTISRDNSK NTLYLQMNSLRAEDTAVYYCARGGQLDYYYYYVMDVWG QGTTVTVSS |
| 27 | 19D3 (VL) | DIQMTQSPSSLSASVGDRVTITCRASQGISSWLAWYQQ KPEKAPKSLIYAASSLQSGVP SRFSGSGSGTDFTLTISSLQPEDFATYYCQQYNSYPYT FGQGTKLEIK |
| 28 | 19D3 (full length wild-type heavy chain) The constant region is underlined | QVQLVESGGGVVQPGRSLRLSCAASGFTFSSYGFHWVR QAPGKGLEWVAVIWYAGSNKFYADSVKGRFTISRDNSK NTLYLQMNSLRAEDTAVYYCARGGQLDYYYYYVMDVWG QGTTVTVSS<u>ASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKCCVE CPPCPAPPVAGPSVFLFPPKPKDTLMISRTPEVTCVVV DVSHEDPEVQFNWYVDGVEVHNAKTKPREEQFNSTFRV VSVLTVVHQDWLNGKEYKCKVSNKGLPAPIEKTISKTK GQPREPQVYTLPPSREEMTKNQVSLTCLVKGFYPSDIA VEWESNGQPENNYKTTPPMLDSDGSFFLYSKLTVDKSR WQQGNVFSCSVMHEALHNHYTQKSLSLSPGK</u> |

TABLE 2-continued

SEQUENCES

| SEQ ID | Description | Sequence |
|---|---|---|
| 29 | 19D3 (full length wild-type light chain) The constant region is underlined | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 30 | 19D3.IgG1 (VH + IgG1) | QVQLVESGGGVVQPGRSLRLSCAASGFTFSSYGFHWVR QAPGKGLEWVAVIWYAGSNKFYADSVKGRFTISRDNSK NTLYLQMNSLRAEDTAVYYCARGGQLDYYYYYVMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKRVEPKSCDK THTCPPCPAPELLGGPSVFLFPPKPKDTLMISRTPEVT CVVVDVSHEDPEVKFNWYVDGVEVHNAKTKPREEQYNS TYRVVSVLTVLHQDWLNGKEYKCKVSNKALPAPIEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPG |
| 31 | 19D3.IgG1.1 (VH + IgG1.1) | QVQLVESGGGVVQPGRSLRLSCAASGFTFSSYGFHWVR QAPGKGLEWVAVIWYAGSNKFYADSVKGRFTISRDNSK NTLYLQMNSLRAEDTAVYYCARGGQLDYYYYYVMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKRVEPKSCDK THTCPPCPAPE<u>AEG</u>APSVFLFPPKPKDTLMISRTPEVT CVVVDVSHEDPEVKFNWYVDGVEVHNAKTKPREEQYNS TYRVVSVLTVLHQDWLNGKEYKCKVSNKALP<u>SS</u>IEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPG |
| 32 | 19D3.IgG1 (VL + CL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 33 | 19D3 VH CDR1 | SYGFH |
| 34 | 19D3 VH CDR2 | VIWYAGSNKFYADSVKG |
| 35 | 19D3 VH CDR3 | GGQLDYYYYYVMDV |
| 36 | 19D3 VL CDR1 | RASQGISSWLA |
| 37 | 19D3 VL CDR2 | AASSLQS |
| 38 | 19D3 VL CDR3 | QQYNSYPYT |
| 39 | 18E10 (VH) | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSS |
| 40 | 18E10 (VL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK |
| 41 | 18E10 (full length wild-type heavy chain) The constant region is underlined | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSS<u>ASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKCCVE CPPCPAPPVAGPSVFLFPPKPKDTLMISRTPEVTCVVV DVSHEDPEVQFNWYVDGVEVHNAKTKPREEQFNSTFRV VSVLTVVHQDWLNGKEYKCKVSNKGLPAPIEKTISKTK GQPREPQVYTLPPSREEMTKNQVSLTCLVKGFYPSDIA VEWESNGQPENNYKTTPPMLDSDGSFFLYSKLTVDKSR WQQGNVFSCSVMHEALHNHYTQKSLSLSPGK</u> |

TABLE 2-continued

SEQUENCES

| SEQ ID | Description | Sequence |
|---|---|---|
| 42 | 18E10 (full length wild-type light chain) The constant region is underlined | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 43 | 18E10.IgG1 (VH + IgG1) | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKRVEPKSCDK THTCPPCPAPELLGGPSVFLF PPKPKDTLMISRTPEVTCVVVDVSHEDPEVKFNWYVDG VE VHNAKTKPREEQYNSTYRVVSVLTVLHQDWLNGKEYKC KV SNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHYT QKSLSLSPG |
| 44 | 18E10.IgG1.1 (VH IgG1.1) | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPSSKSTSGGTAALGCLV KDYFPEPVTVSWNSGALTSGVHTFPAVLQSSGLYSLSS VVTVPSSSLGTQTYICNVNHKPSNTKVDKRVEPKSCDK THTCPPCPAPE<u>AEG</u>APSVFLFPPKPKDTLMISRTPEVT CVVVDVSHEDPEVKFNWYVDGVEVHNAKTKPREEQYNS TYRVVSVLTVLHQDWLNGKEYKCKVSNKALP<u>SS</u>IEKTI SKAKGQPREPQVYTLPPSREEMTKNQVSLTCLVKGFYP SDIAVEWESNGQPENNYKTTPPVLDSDGSFFLYSKLTV DKSRWQQGNVFSCSVMHEALHNHYTQKSLSLSPG |
| 45 | 18E10.IgG1 (VL + CL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 46 | 18E10 VH CDR1 | SYGMH |
| 47 | 18E10 VH CDR2 | VIWYAGSNKYYADSVKG |
| 48 | 18E10 VH CDR3 | GGRIAVAFYYSMDV |
| 49 | 18E10 VL CDR1 | RASQGISSWLA |
| 50 | 18E10 VL CDR2 | AASSLQS |
| 51 | 18E10 VL CDR3 | QQYNSYPYT |
| 52 | 3C3 (VH) | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSS |
| 53 | 3C3 (VL1) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK |
| 54 | 3C3 (VL2) | EIVLTQSPATLSLSPGERATLSCRASQGVSSYLAWYQQ KPGQAPRLLIYDASNRATGIPARFSGSGPGTDFTLTIS SLEPEDFAVYYCQQRSNWHTFGQGTKLEIK |
| 55 | 3C3 (full length wild-type heavy chain) The constant region is underlined | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSS<u>ASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPELLGGPSVFLFPPKPKDTLMISRTPEVTCVVVDV</u> |

TABLE 2-continued

SEQUENCES

| SEQ ID | Description | Sequence |
|---|---|---|
| | | SHEDPEVKFNWYVDGVEVHNAKTKPREEQYNSTYRVVS VLTVLHQDWLNGKEYKCKVSNKALPAPIEKTISKAKGQ PREPQVYTLPPSRDELTKNQVSLTCLVKGFYPSDIAVE WESNGQPENNYKTTPPVLDSDGSFFLYSKLTVDKSRWQ QGNVFSCSVMHEALHNHYTQKSLSLSPGK |
| 56 | 3C3 L1 (full length wild-type light chain 1) The constant region is underlined | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 57 | 3C3 L2 (full length wild-type light chain 2) The constant region is underlined | EIVLTQSPATLSLSPGERATLSCRASQGVSSYLAWYQQ KPGQAPRLLIYDASNRATGIPARFSGSGPGTDFTLTIS SLEPEDFAVYYCQQRSNWHTFGQGTKLEIKRTVAAPSV FIFPPSDEQLKSGTASVVCLLNNFYPREAKVQWKVDNA LQSGNSQESVTEQDSKDSTYSLSSTLTLSKADYEKHKV YACEVTHQGLSSPVTKSFNRGEC |
| 58 | 3C3.1gG1 (VH + IgG1) | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPELLGGPSVFLF PPKPKDTLMISRTPEVTCVVVDVSHEDPEVKFNWYVDG VE VHNAKTKPREEQYNSTYRVVSVLTVLHQDWLNGKEYKC KV SNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHYT QKSLSLSPG |
| 59 | 3C3.IgG1.1 (VH + IgG1.1) | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPEAEGAPSVFLFPPKPKDTLMISRTPEVTCVVVDV SHEDPEVKFNWYVDGVEVHNAKTKPREEQYNSTYRVVS VLTVLHQDWLNGKEYKCKVSNKALPSSIEKTISKAKGQ PREPQVYTLPPSREEMTKNQVSLTCLVKGFYPSDIAVE WESNGQPENNYKTTPPVLDSDGSFFLYSKLTVDKSRWQ QGNVFSCSVMHEALHNHYTQKSLSLSPG |
| 60 | 3C3.IgG1 (VL1 + CL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 61 | 3C3IgG1.2 (VL2 + CL) | EIVLTQSPATLSLSPGERATLSCRASQGVSSYLAWYQQ KPGQAPRLLIYDASNRATGIPARFSGSGPGTDFTLTIS SLEPEDFAVYYCQQRSNWHTFGQGTKLEIKRTVAAPSV FIFPPSDEQLKSGTASVVCLLNNFYPREAKVQWKVDNA LQSGNSQESVTEQDSKDSTYSLSSTLTLSKADYEKHKV YACEVTHQGLSSPVTKSFNRGEC |
| 62 | 3C3 VH CDR1 | GYYWT |
| 63 | 3C3 VH CDR2 | KINHSGNTNYNPSLKS |
| 64 | 3C3 VH CDR3 | LGAFDAFDI |
| 65 | 3C3 VL1 CDR1 | RASQGISSWLA |
| 66 | 3C3 VL1 CDR2 | AASSLQS |
| 67 | 3C3 VL1 CDR3 | QQYNSYPYT |

TABLE 2-continued

SEQUENCES

| SEQ ID | Description | Sequence |
|---|---|---|
| 68 | 3C3 VL2 CDR1 | RASQGVSSYLA |
| 69 | 3C3 VL2 CDR2 | DASNRAT |
| 70 | 3C3 VL2 CDR3 | QQRSNWHT |
| 71 | 2G6 (VH) | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSS |
| 72 | 2G6 (VL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK |
| 73 | 2G6 (full length wild-type heavy chain) The constant region is underlined | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSS<u>ASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVQFNWYVDGVEVHNAKTKPREEQFNSTFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPGK</u> |
| 74 | 2G6 (full length wild-type light chain) The constant region is underlined | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 75 | 2G6.IgG1 (VH + IgG1) | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPELLGGPSVFLF PPKPKDTLMISRTPEVTCVVVDVSHEDPEVKFNWYVDG VE VHNAKTKPREEQYNSTYRVVSVLTVLHQDWLNGKEYKC KV SNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHYT QKSLSLSPG |
| 76 | 2G6.IgG1.1 (VH + IgG1.1) | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPE<u>AEGA</u>PSVFLFPPKPKDTLMISRTPEV TCVVVDVSHEDPEVKFNWYVDGVEVHNAKTKPREEQYN STYRVVSVLTVLHQDWLNGKEYKCKVSNKALP<u>SSI</u>EKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPG |
| 77 | 2G6.IgG1 (VL + CL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 78 | 2G6 VH CDR1 | DYGMH |
| 79 | 2G6 VH CDR2 | VIWYDGSNKFYVDSVKG |

TABLE 2-continued

SEQUENCES

| SEQ ID | Description | Sequence |
|---|---|---|
| 80 | 2G6 VH CDR3 | GGRLATGHFYYVMDV |
| 81 | 2G6 VL CDR1 | RASQGISSWLA |
| 82 | 2G6 VL CDR2 | AASSLQS |
| 83 | 2G6 VL CDR3 | QQYNSYPYT |
| 84 | 8A6 (VH) | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSS |
| 85 | 8A6 (VL) | AIQLTQSPSSLSASVGDRVTITCRASQGISSALAWYQQ KPGKAPKFLIYDASSLESGVPSRFSGSGSGTDFTLTIS SLQPEDFATYYCQQFNSYPYTFGQGTKLEIK |
| 86 | 8A6 (full length wild-type heavy chain) The constant region is underlined | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSS<u>ASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVQFNWYVDGVEVHNAKTKPREEQFNSTFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPGK</u> |
| 87 | 8A6 (full length wild-type light chain) The constant region is underlined | AIQLTQSPSSLSASVGDRVTITCRASQGISSALAWYQQ KPGKAPKFLIYDASSLESGVPSRFSGSGSGTDFTLTIS SLQPEDFATYYCQQFNSYPYTFGQGTKLEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 88 | 8A6.IgG1 (VH + IgG1) | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPELLGGPSVFLFPPKPKDTLMISRTPEV TCVVVDVSHEDPEVKFNWYVDGVEVHNAKTKPREEQYN STYRVVSVLTVLHQDWLNGKEYKCKVSNKALPAPIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPG |
| 89 | 8A6.IgG1.1 (VH + IgG1.1) | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPE<u>AEGA</u>PSVFLFPPKPKDTLMISRTPEV TCVVVDVSHEDPEVKFNWYVDGVEVHNAKTKPREEQYN STYRVVSVLTVLHQDWLNGKEYKCKVSNKALP<u>SS</u>IEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPG |
| 90 | 8A6.IgG1 (VL + CL) | AIQLTQSPSSLSASVGDRVTITCRASQGISSALAWYQQ KPGKAPKFLIYDASSLESGVPSRFSGSGSGTDFTLTIS SLQPEDFATYYCQQFNSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 91 | 8A6 VH CDR1 | SYGMQ |
| 92 | 8A6 VH CDR2 | VIWYEGSNKYYADSVKG |
| 93 | 8A6 VH CDR3 | GGLMVRGLFYYGMDV |

TABLE 2-continued

SEQUENCES

| SEQ ID | Description | Sequence |
|---|---|---|
| 94 | 8A6 VL CDR1 | RASQGISSALA |
| 95 | 8A6 VL CDR2 | DASSLES |
| 96 | 8A6 VL CDR3 | QQFNSYPYT |
| 97 | 9G7 (VH) | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSS |
| 98 | 9G7 (VL1) | EIVLTQSPGTLSLSPGERATLSCRASQSVSSSYLAWYQ QKPGQAPRLLIYGASSRATGIPDRFSGSGSGTDFTLTI SRLEPEDFAVYYCQQYGSSPWTFGQGTKVEIK |
| 99 | 9G7 (VL2) | EIVLTQSPGTLSLSPGERATLSCRASQSVTSSYLAWYQ QKPGQAPRLLIYGASSRATGIPERFSGSGSGTDFTLTI SRLEPEDFAVYYCQQYGSSPITFGQGTRLEIK |
| 100 | 9G7 (full length wild-type heavy chain) The constant region is underlined | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSS<u>ASTKGPSVFPLAPCSRSTSESTAALGC LVKDYFPEPVTVSWNSGALTSGVHTFPAVLQSSGLYSL SSVVTVPSSSLGTKTYTCNVDHKPSNTKVDKRVESKYG PPCPSCPAPEFLGGPSVFLFPPKPKDTLMISRTPEVTC VVVDVSQEDPEVQFNWYVDGVEVHNAKTKPREEQFNST YRVVSVLTVLHQDWLNGKEYKCKVSNKGLPSSIEKTIS KAKGQPREPQVYTLPPSQEEMTKNQVSLTCLVKGFYPS DIAVEWESNGQPENNYKTTPPVLDSDGSFFLYSRLTVD KSRWQEGNVFSCSVMHEALHNHYTQKSLSLSLGK</u> |
| 101 | 9G7 L2 (full length wild-type light chain 2) The constant region is underlined | EIVLTQSPGTLSLSPGERATLSCRASQSVTSSYLAWYQ QKPGQAPRLLIYGASSRATGIPERFSGSGSGTDFTLTI SRLEPEDFAVYYCQQYGSSPITFGQGTRLEIK<u>RTVAAP SVFIFPPSDEQLKSGTASVVCLLNNFYPREAKVQWKVD NALQSGNSQESVTEQDSKDSTYSLSSTLTLSKADYEKH KVYACEVTHQGLSSPVTKSFNRGEC</u> |
| 102 | 9G7.IgG1 (VH + IgG1) | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKRVEPKSC DKTHTCPPCPAPELLGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALPAPIEK IISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPG |
| 103 | 9G7.IgG1.1 (VH + IgG1.1) | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKRVEPKSC DKTHTCPPCPAPE<u>AEGA</u>PSVFLFPPKPKDTLMISRTPE VTCVVVDVSHEDPEVKFNWYVDGVEVHNAKTKPREEQY NSTYRVVSVLTVLHQDWLNGKEYKCKVSNKALP<u>SSI</u>EK IISKAKGQPREPQVYTLPPSREEMTKNQVSLTCLVKGF YPSDIAVEWESNGQPENNYKTTPPVLDSDGSFFLYSKL TVDKSRWQQGNVFSCSVMHEALHNHYTQKSLSLSPG |
| 104 | 9G7.IgG1 (VL1 + CL) | EIVLTQSPGTLSLSPGERATLSCRASQSVSSSYLAWYQ QKPGQAPRLLIYGASSRATGIPDRFSGSGSGTDFTLTI SRLEPEDFAVYYCQQYGSSPWTFGQGTKVEIKRTVAAP SVFIFPPSDEQLKSGTASVVCLLNNFYPREAKVQWKVD NALQSGNSQESVTEQDSKDSTYSLSSTLTLSKADYEKH KVYACEVTHQGLSSPVTKSFNRGEC |
| 105 | 9G7.IgG1.2 (VL2 + CL) | EIVLTQSPGTLSLSPGERATLSCRASQSVTSSYLAWYQ QKPGQAPRLLIYGASSRATGIPERFSGSGSGTDFTLTI |

TABLE 2-continued

SEQUENCES

| SEQ ID | Description | Sequence |
|---|---|---|
| | | SRLEPEDFAVYYCQQYGSSPITFGQGTRLEIKRTVAAP SVFIFPPSDEQLKSGTASVVCLLNNFYPREAKVQWKVD NALQSGNSQESVTEQDSKDSTYSLSSTLTLSKADYEKH KVYACEVTHQGLSSPVTKSFNRGEC |
| 106 | 9G7 VH CDR1 | TVWMS |
| 107 | 9G7 VH CDR2 | RIKSKTDGGTTDYAAPVKG |
| 108 | 9G7 VH CDR3 | GQLIPYSYYYGMDV |
| 109 | 9G7 VL1 CDR1 | RASQSVSSSYLA |
| 110 | 9G7 VL1 CDR2 | GASSRAT |
| 111 | 9G7 VL1 CDR3 | QQYGSSPWT |
| 112 | 9G7 VL2 CDR1 | RASQSVTSSYLA |
| 113 | 9G7 VL2 CDR2 | GASSRAT |
| 114 | 9G7 VL2 CDR3 | QQYGSSPIT |
| 115 | 14E3 (VH) | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSS |
| 116 | 14E3 (VL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPPTFGQGTKVEIK |
| 117 | 14E3 (full length wild-type heavy chain) The constant region is underlined | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPELLGGPSVFLFPPKPKDTLMISRTPEVTCVVVDV SHEDPEVKFNWYVDGVEVHNAKTKPREEQYNSTYRVVS VLTVLHQDWLNGKEYKCKVSNKALPAPIEKTISKAKGQ PREPQVYTLPPSRDELTKNQVSLTCLVKGFYPSDIAVE WESNGQPENNYKTTPPVLDSDGSFFLYSKLTVDKSRWQ QGNVFSCSVMHEALHNHYTQKSLSLSPGK |
| 118 | 14E3 (full length wild-type light chain) The constant region is underlined | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPPTFGQGTKVEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 119 | 14E3.IgG1 (VH + IgG1) | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPELLGGPSVFLF PPKPKDTLMISRTPEVTCVVVDVSHEDPEVKFNWYVDG VE VHNAKTKPREEQYNSTYRVVSVLTVLHQDWLNGKEYKC KV SNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHYT QKSLSLSPG |
| 120 | 14E3.IgG1.1 (VH + IgG1.1) | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPSSKSTSGGTAALGCLVKDYFPE PVTVSWNSGALTSGVHTFPAVLQSSGLYSLSSVVTVPS SSLGTQTYICNVNHKPSNTKVDKRVEPKSCDKTHTCPP CPAPE_AEGA_PSVFLFPPKPKDTLMISRTPEVTCVVVDV |

TABLE 2-continued

SEQUENCES

| SEQ ID | Description | Sequence |
|---|---|---|
| | | SHEDPEVKFNWYVDGVEVHNAKTKPREEQYNSTYRVVS VLTVLHQDWLNGKEYKCKVSNKALPSSIEKTISKAKGQ PREPQVYTLPPSREEMTKNQVSLTCLVKGFYPSDIAVE WESNGQPENNYKTTPPVLDSDGSFFLYSKLTVDKSRWQ QGNVFSCSVMHEALHNHYTQKSLSLSPG |
| 121 | 14E3.1gG1 (VL + CL) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSYPPTFGQGTKVEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 122 | 14E3 VH CDR1 | GYYWS |
| 123 | 14E3 VH CDR2 | EINHSGNTYYNPSLKS |
| 124 | 14E3 VH CDR3 | FGSNDAFDI |
| 125 | 14E3 VL CDR1 | RASQGISSWLA |
| 126 | 14E3 VL CDR2 | AASSLQS |
| 127 | 14E3 VL CDR3 | QQYNSYPPT |
| 128 | 19H8 (VH) | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSS |
| 129 | 19H8 (VL1) | AIQLTQSPSSLSASVGDRVTITCRASQGISSALAWYQQ KPGKAPKFLIYDASSLESGVPSRFSGSGSGTDFTLTIS SLQPEDFATYYCQQFNSYPQTFGQGTKVEIK |
| 130 | 19H8 (VL2) | EIVLTQSPATLSLSPGERATLSCRASQSVSSYLAWYQQ KPGQAPRLLIYDASNRATGIPARFSGSGSGTDFTLTIS SLEPEDFAVYYCQQRSNWPLTFGGGTKVEIK |
| 131 | 19H8 (full length wild-type heavy chain) The constant region is underlined | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSS<u>ASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVQFNWYVDGVEVHNAKTKPREEQFNSTFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPGK</u> |
| 132 | 19H8 L1 (full length wild-type light chain 1) The constant region is underlined | AIQLTQSPSSLSASVGDRVTITCRASQGISSALAWYQQ KPGKAPKFLIYDASSLESGVPSRFSGSGSGTDFTLTIS SLQPEDFATYYCQQFNSYPQTFGQGTKVEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 133 | 19H8 L2 (full length wild-type light chain 2) | EIVLTQSPATLSLSPGERATLSCRASQSVSSYLAWYQQ KPGQAPRLLIYDASNRATGIPARFSGSGSGTDFTLTIS SLEPEDFAVYYCQQRSNWPLTFGGGTKVEIK<u>RTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC</u> |
| 134 | 19H8.IgG1 (VH + IgG1) | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPELLGGPSVFLF PPKPKDTLMISRTPEVTCVVVDVSHEDPEVKFNWYVDG VE |

TABLE 2-continued

SEQUENCES

| SEQ ID | Description | Sequence |
|---|---|---|
| | | VHNAKTKPREEQYNSTYRVVSVLTVLHQDWLNGKEYKCKV SNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHYT QKSLSLSPG |
| 135 | 19H8.IgG1.1 (VH + IgG1.1) | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPSSKSTSGGTAALGCL VKDYFPEPVTVSWNSGALTSGVHTFPAVLQSSGLYSLS SVVTVPSSSLGTQTYICNVNHKPSNTKVDKRVEPKSCD KTHTCPPCPAPEAEGAPSVFLFPPKPKDTLMISRTPEV TCVVVDVSHEDPEVKFNWYVDGVEVHNAKTKPREEQYN STYRVVSVLTVLHQDWLNGKEYKCKVSNKALPSSIEKT ISKAKGQPREPQVYTLPPSREEMTKNQVSLTCLVKGFY PSDIAVEWESNGQPENNYKTTPPVLDSDGSFFLYSKLT VDKSRWQQGNVFSCSVMHEALHNHYTQKSLSLSPG |
| 136 | 19H8.IgG1 (VL1 + CL) | AIQLTQSPSSLSASVGDRVTITCRASQGISSALAWYQQ KPGKAPKFLIYDASSLESGVPSRFSGSGSGTDFTLTIS SLQPEDFATYYCQQFNSYPQTFGQGTKVEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 137 | 19H8.IgG1.2 (VL2 + CL) | EIVLTQSPATLSLSPGERATLSCRASQSVSSYLAWYQQ KPGQAPRLLIYDASNRATGIPARFSGSGSGTDFTLTIS SLEPEDFAVYYCQQRSNWPLTFGGGTKVEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC |
| 138 | 19H8 VH CDR1 | NYGMH |
| 139 | 19H8 VH CDR2 | VIWYGGSNKFYADSVKG |
| 140 | 19H8 VH CDR3 | GGAMVRGVYYYGMDV |
| 141 | 19H8 VL1 CDR1 | RASQGISSALA |
| 142 | 19H8 VL1 CDR2 | DASSLES |
| 143 | 19H8 VL1 CDR3 | QQFNSYPQT |
| 144 | 19H8 VL2 CDR1 | RASQSVSSYLA |
| 145 | 19H8 VL2 CDR2 | DASNRAT |
| 146 | 19H8 VL2 CDR3 | QQRSNWPLT |
| 147 | 28F3 (VH) nucleotide sequence | CAGGTGCAGCTGGTGGAGTCTGGGGGAGGCGTGGTCCA GCCTGGGAGGTCCCTGAGACTCTCCTGTGCAGCGTCTG GATTCACCTTCAGTAGCTATGGCATGCACTGGGTCCGC CAGGCTCCAGGCAAGGGGCTGGAGTGGGTGGCAGTTAT ATGGTATGAAGGAAGTAATAAATATTATGCAGACTCCG TGAAGGGCCGATTCACCATCTCCAGAGACAATTCCAAG AACACGCTGTATCTGCAAATGAACAGCCTGAGAGCCGA GGACACGGCTGTGTATTACTGTGCGAGAGGGGGGAGTA TGGTTCGGGGGGACTACTACACGGTATGGACGTCTGG GGCCAAGGGACCACGGTCACCGTCTCCTCA |
| 148 | 28F3 (VL) nucleotide sequence | GCCATCCAGTTGACCCAGTCTCCATCCTCCCTGTCTGC ATCTGTAGGAGACAGAGTCACCATCACTTGCCGGGCAA GTCAGGGCATTAGCAGTGCTTTAGCCTGGTATCAGCAG AAACCAGGGAAAGCTCCTAAGCTCCTGATCTATGATGC CTCCAGTTTGGAAAGTGGGGTCCCATCAAGGTTCAGCG GCAGTGGATCTGGGACAGATTTCACTCTCACCATCAGC AGCCTGCAGCCTGAAGATTTTGCAACTTATTACTGTCA ACAGTTTAATAGTTACCCGTACACTTTTGGCCAGGGGA CCAAGCTGGAGATCAAA |

TABLE 2-continued

SEQUENCES

| SEQ ID | Description | Sequence |
|---|---|---|
| 149 | 28F3 (full length wild-type heavy chain) nucleotide sequence<br>The sequence encoding the constant region is underlined | CAGGTGCAGCTGGTGGAGTCTGGGGGAGGCGTGGTCCA<br>GCCTGGGAGGTCCCTGAGACTCTCCTGTGCAGCGTCTG<br>GATTCACCTTCAGTAGCTATGGCATGCACTGGGTCCGC<br>CAGGCTCCAGGCAAGGGGCTGGAGTGGGTGGCAGTTAT<br>ATGGTATGAAGGAAGTAATAAATATTATGCAGACTCCG<br>TGAAGGGCCGATTCACCATCTCCAGAGACAATTCCAAG<br>AACACGCTGTATCTGCAAATGAACAGCCTGAGAGCCGA<br>GGACACGGCTGTGTATTACTGTGCGAGAGGGGGGAGTA<br>TGGTTCGGGGGGACTACTACTACGGTATGGACGTCTGG<br>GGCCAAGGGACCACGGTCACCGTCTCCTCA<u>GCCTCCAC<br>CAAGGGCCCATCGGTCTTCCCCCTGGCGCCCTGCTCCA<br>GGAGCACCTCCGAGAGCACAGCGGCCCTGGGCTGCCTG<br>GTCAAGGACTACTTCCCCGAACCGGTGACGGTGTCGTG<br>GAACTCAGGCGCTCTGACCAGCGGCGTGCACACCTTCC<br>CAGCTGTCCTACAGTCCTCAGGACTCTACTCCCTCAGC<br>AGCGTGGTGACCGTGCCCTCCAGCAACTTCGGCACCCA<br>GACCTACACCTGCAACGTAGATCACAAGCCCAGCAACA<br>CCAAGGTGGACAAGACAGTTGAGCGCAAATGTTGTGTC<br>GAGTGCCCACCGTGCCCAGCACCACCTGTGGCAGGACC<br>GTCAGTCTTCCTCTTCCCCCCAAAACCCAAGGACACCC<br>TCATGATCTCCCGGACCCCTGAGGTCACGTGCGTGGTG<br>GTGGACGTGAGCCACGAAGACCCCGAGGTCCAGTTCAA<br>CTGGTACGTGGACGGCGTGGAGGTGCATAATGCCAAGA<br>CAAAGCCACGGGAGGAGCAGTTCAACAGCACGTTCCGT<br>GTGGTCAGCGTCCTCACCGTTGTGCACCAGGACTGGCT<br>GAACGGCAAGGAGTACAAGTGCAAGGTCTCCAACAAAG<br>GCCTCCCAGCCCCCATCGAGAAAACCATCTCCAAAACC<br>AAAGGGCAGCCCCGAGAACCACAGGTGTACACCCTGCC<br>CCCATCCCGGGAGGAGATGACCAAGAACCAGGTCAGCC<br>TGACCTGCCTGGTCAAAGGCTTCTACCCCAGCGACATC<br>GCCGTGGAGTGGGAGAGCAATGGGCAGCCGGAGAACAA<br>CTACAAGACCACACCTCCCATGCTGGACTCCGACGGCT<br>CCTTCTTCCTCTACAGCAAGCTCACCGTGGACAAGAGC<br>AGGTGGCAGCAGGGGAACGTCTTCTCATGCTCCGTGAT<br>GCATGAGGCTCTGCACAACCACTACACGCAGAAGAGCC<br>TCTCCCTGTCTCCGGGTAAA</u> |
| 150 | 28F3 (full length wild-type light chain) nucleotide sequence<br>The sequence encoding the constant region is underlined | GCCATCCAGTTGACCCAGTCTCCATCCTCCCTGTCTGCATCTGTAG<br>GAGACAGAGTCACCATCACTTGCCGGGCAAGTCAGGGCATTAGCAG<br>TGCTTTAGCCTGGTATCAGCAGAAACCAGGGAAAGCTCCTAAGCTC<br>CTGATCTATGATGCCTCCAGTTTGGAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGTCAACAGTTTAAT<br>AGTTACCCGTACACTTTTGGCCAGGGGACCAAGCTGGAGATCAAA<u>C<br>GAACTGTGGCTGCACCATCTGTCTTCATCTTCCCGCCATCTGATGA<br>GCAGTTGAAATCTGGAACTGCCTCTGTTGTGTGCCTGCTGAATAAC<br>TTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>GCCTGAGCTCGCCCGTCACAAAGAGCTTCAACAGGGGAGAGTGT</u> |
| 151 | 28F3.IgG1 (VH + IgG1) nucleotide sequence | caggtgcagc tggtggagtc tgggggaggc gtggtccagc<br>ctgggaggtc cctgagactc tcctgtgcag cgtctggatt<br>caccttcagt agctatggca tgcactgggt ccgccaggct<br>ccaggcaagg ggctggagtg ggtggcagtt atatggtatg<br>aaggaagtaa taaatattat gcagactccg tgaagggccg<br>attcaccatc tccagagaca attccaagaa cacgctgtat<br>ctgcaaatga acagcctgag agccgaggac acggctgtgt<br>attactgtgc gagaggggg agtatggttc gggggacta<br>ctactacggt atggacgtct gggggccaagg gaccacggtc<br>accgtctcct cagctagcac caagggccca tcggtcttcc<br>ccctggcacc ctcctccaag agcacctctg ggggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc cagcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>ctcctggggg gaccgtcagt cttcctcttc cccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg |

TABLE 2-continued

SEQUENCES

| SEQ ID | Description | Sequence |
|---|---|---|
| | | ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccagc ccccatcgag aaaaccatct ccaaagccaa<br>agggcagccc cgagaaccac aggtgtacac cctgccccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg<br>tccccgggtt ga |
| 152 | 28F3.IgG1.1 (VH + IgG1.1) nucleotide sequence | caggtgcagc tggtggagtc tgggggaggc gtggtccagc<br>ctgggaggtc cctgagactc tcctgtgcag cgtctggatt<br>caccttcagt agctatggca tgcactgggt ccgccaggct<br>ccaggcaagg ggctggagtg ggtggcagtt atatggtatg<br>aaggaagtaa taaatattat gcagactccg tgaagggccg<br>attcaccatc tccagagaca attccaagaa cacgctgtat<br>ctgcaaatga acagcctgag agccgaggac acggctgtgt<br>attactgtgc gagaggggg agtatggttc gggggacta<br>ctactacggt atggacgtct ggggccaagg gaccacggtc<br>accgtctcct cagctagcac caagggccca tcggtcttcc<br>ccctggcacc ctcctccaag agcacctctg ggggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc cagcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>gccgaagggg cccgtcagt cttcctcttc ccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg<br>ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccaag cagcatcgag aaaaccatct ccaaagccaa<br>agggcagccc cgagaaccac aggtgtacac cctgccccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg<br>tccccgggtt ga |
| 153 | 28F3.IgG1 (VL + CL) nucleotide sequence | gccatccagt tgacccagtc tccatcctcc ctgtctgcat<br>ctgtaggaga cagagtcacc atcacttgcc gggcaagtca<br>gggcattagc agtgctttag cctggtatca gcagaaacca<br>gggaaagctc ctaagctcct gatctatgat gcctccagtt<br>tggaaagtgg ggtcccatca aggttcagcg gcagtggatc<br>tgggacagat ttcactctca ccatcagcag cctgcagcct<br>gaagattttg caacttatta ctgtcaacag tttaatagtt<br>acccgtacac ttttggccag gggaccaagc tggagatcaa<br>acgtacggtg gctgcaccat ctgtcttcat cttcccgcca<br>tctgatgagc agttgaaatc tggaactgcc tctgttgtgt<br>gcctgctgaa taacttctat cccagagagg ccaaagtaca<br>gtggaaggtg gataacgccc tccaatcggg taactcccag<br>gagagtgtca cagagcagga cagcaaggac agcacctaca<br>gcctcagcag caccctgacg ctgagcaaag cagactacga<br>gaaacacaaa gtctacgcct gcgaagtcac ccatcagggc<br>ctgagctcgc ccgtcacaaa gagcttcaac<br>aggggagagt gttag |
| 154 | 19D3 (VH) nucleotide sequence | CAGGTGCAGCTGGTGGAGTCTGGGGGAGGCGTGGTCCA<br>ACCTGGAGGTCCCTGAGACTCTCCTGTGCAGCGTCTG<br>GATTCACCTTCAGTAGCTATGGCTTCCACTGGGTCCGC<br>CAGGCTCCAGGCAAGGGGCTGGAGTGGGTGGCAGTTAT<br>ATGGTATGCTGGAAGTAATAAATTCTATGCAGACTCCG<br>TGAAGGGCCGATTCACCATCTCCAGAGACAATTCCAAG<br>AACACGCTGTATCTGCAAATGAACAGCCTAAGAGCCGA |

TABLE 2-continued

SEQUENCES

| SEQ ID | Description | Sequence |
|---|---|---|
| | | GGACACGGCTGTGTATTACTGTGCGAGAGGGGGACAGT TGGACTACTACTACTATTACGTTATGGACGTCTGGGGC CAAGGGACCACGGTCACCGTCTCCTCA |
| 155 | 19D3 (VL) nucleotide sequence | GACATCCAGATGACCCAGTCTCCATCCTCACTGTCTGC ATCTGTAGGAGACAGAGTCACCATCACTTGTCGGGCGA GTCAGGGTATTAGCAGCTGGTTAGCCTGGTATCAGCAG AAACCAGAGAAAGCCCCTAAGTCCCTGATCTATGCTGC ATCCAGTTTGCAAAGTGGGGTCCCATCAAGGTTCAGCG GCAGTGGATCTGGGACAGATTTCACTCTCACCATCAGC AGCCTGCAGCCTGAAGATTTTGCAACTTATTACTGCCA ACAGTATAATAGTTACCCGTACACTTTTGGCCAGGGGA CCAAGCTGGAGATCAAA |
| 156 | 19D3 (full length wild-type heavy chain) nucleotide sequence The sequence encoding the constant region is underlined | CAGGTGCAGCTGGTGGAGTCTGGGGGAGGCGTGGTCCA ACCTGGGAGGTCCCTGAGACTCTCCTGTGCAGCGTCTG GATTCACCTTCAGTAGCTATGGCTTCCACTGGGTCCGC CAGGCTCCAGGCAAGGGGCTGGAGTGGGTGGCAGTTAT ATGGTATGCTGGAAGTAATAAATTCTATGCAGACTCCG TGAAGGGCCGATTCACCATCTCCAGAGACAATTCCAAG AACACGCTGTATCTGCAAATGAACAGCCTAAGAGCCGA GGACACGGCTGTGTATTACTGTGCGAGAGGGGGACAGT TGGACTACTACTACTATTACGTTATGGACGTCTGGGGC CAAGGGACCACGGTCACCGTCTCCTCAGCCTCCACCAA GGGCCCATCGGTCTTCCCCCTGGCGCCCTGCTCCAGGA GCACCTCCGAGAGCACAGCGGCCCTGGGCTGCCTGGTC AAGGACTACTTCCCCGAACCGGTGACGGTGTCGTGGAA CTCAGGCGCTCTGACCAGCGGCGTGCACACCTTCCCAG CTGTCCTACAGTCCTCAGGACTCTACTCCCTCAGCAGC GTGGTGACCGTGCCCTCCAGCAACTTCGGCACCCAGAC CTACACCTGCAACGTAGATCACAAGCCCAGCAACACCA AGGTGGACAAGACAGTTGAGCGCAAATGTTGTGTCGAG TGCCCACCGTGCCCAGCACCACCTGTGGCAGGACCGTC AGTCTTCCTCTTCCCCCCAAAACCCAAGGACACCCTCA TGATCTCCCGGACCCCTGAGGTCACGTGCGTGGTGGTG GACGTGAGCCACGAAGACCCCGAGGTCCAGTTCAACTG GTACGTGGACGGCGTGGAGGTGCATAATGCCAAGACAA AGCCACGGGAGGAGCAGTTCAACAGCACGTTCCGTGTG GTCAGCGTCCTCACCGTTGTGCACCAGGACTGGCTGAA CGGCAAGGAGTACAAGTGCAAGGTCTCCAACAAAGGCC TCCCAGCCCCCATCGAGAAAACCATCTCCAAAACCAAA GGGCAGCCCCGAGAACCACAGGTGTACACCCTGCCCCC ATCCCGGGAGGAGATGACCAAGAACCAGGTCAGCCTGA CCTGCCTGGTCAAAGGCTTCTACCCCAGCGACATCGCC GTGGAGTGGGAGAGCAATGGGCAGCCGGAGAACAACTA CAAGACCACACCTCCCATGCTGGACTCCGACGGCTCCT TCTTCCTCTACAGCAAGCTCACCGTGGACAAGAGCAGG TGGCAGCAGGGGAACGTCTTCTCATGCTCCGTGATGCA TGAGGCTCTGCACAACCACTACACGCAGAAGAGCCTCT CCCTGTCTCCGGGTAAA |
| 157 | 19D3 (full length wild-type light chain) nucleotide sequence The sequence encoding the constant region is underlined | GACATCCAGATGACCCAGTCTCCATCCTCACTGTCTGC ATCTGTAGGAGACAGAGTCACCATCACTTGTCGGGCGA GTCAGGGTATTAGCAGCTGGTTAGCCTGGTATCAGCAG AAACCAGAGAAAGCCCCTAAGTCCCTGATCTATGCTGC ATCCAGTTTGCAAAGTGGGGTCCCATCAAGGTTCAGCG GCAGTGGATCTGGGACAGATTTCACTCTCACCATCAGC AGCCTGCAGCCTGAAGATTTTGCAACTTATTACTGCCA ACAGTATAATAGTTACCCGTACACTTTTGGCCAGGGGA CCAAGCTGGAGATCAAACGAACTGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAAC GCCCTCCAATCGGGTAACTCCCAGGAGAGTGTCACAGA GCAGGACAGCAAGGACAGCACCTACAGCCTCAGCAGCA CCCTGACGCTGAGCAAAGCAGACTACGAGAAACACAAA GTCTACGCCTGCGAAGTCACCCATCAGGGCCTGAGCTC GCCCGTCACAAAGAGCTTCAACAGGGGAGAGTGT |
| 158 | 18E10 (VH) nucleotide sequence | CAGGTGCAGCTGGTGGAGTCTGGGGGAGGCGTGGTCCA GCCTGGGAGGTCCCTGAGACTCTCCTGTGCAGCGTCTG GATTCACCTTCAGTAGCTATGGCATGCACTGGGTCCGC CAGGCTCCAGGCAAGGGGCTGGAGTGGGTGGCAGTTAT ATGGTATGCTGGAAGTAATAAATACTATGCAGACTCCG TGAAGGGCCGATTCACCATCTCCAGAGACAATTCCAAG |

TABLE 2-continued

SEQUENCES

| SEQ ID | Description | Sequence |
|---|---|---|
| | | AACACGCTGTATCTGCAAATGAACAGCCTGAGAGCCGA<br>GGACACGGCTGTGTATTACTGTGCGAGAGGGGGCGTA<br>TAGCAGTGGCCTTCTACTACAGTATGGACGTCTGGGGC<br>CAAGGGACCACGGTCACCGTCTCCTCA |
| 159 | 18E10 (VL) nucleotide sequence | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCGTACACTTTTGGCCAGGGGA<br>CCAAGCTGGAGATCAAA |
| 160 | 18E10 (full length wild-type heavy chain) nucleotide sequence | CAGGTGCAGCTGGTGGAGTCTGGGGGAGGCGTGGTCCA<br>GCCTGGGAGGTCCCTGAGACTCTCCTGTGCAGCGTCTG<br>GATTCACCTTCAGTAGCTATGGCATGCACTGGGTCCGC<br>CAGGCTCCAGGCAAGGGGCTGGAGTGGGTGGCAGTTAT<br>ATGGTATGCTGGAAGTAATAAATACTATGCAGACTCCG<br>TGAAGGGCCGATTCACCATCTCCAGAGACAATTCCAAG<br>AACACGCTGTATCTGCAAATGAACAGCCTGAGAGCCGA<br>GGACACGGCTGTGTATTACTGTGCGAGAGGGGGCGTA<br>TAGCAGTGGCCTTCTACTACAGTATGGACGTCTGGGGC<br>CAAGGGACCACGGTCACCGTCTCCTCA<u>GCCTCCACCAA<br>GGGCCCATCGGTCTTCCCCCTGGCGCCCTGCTCCAGGA<br>GCACCTCCGAGAGCACAGCGGCCCTGGGCTGCCTGGTC<br>AAGGACTACTTCCCCGAACCGGTGACGGTGTCGTGGAA<br>CTCAGGCGCTCTGACCAGCGGCGTGCACACCTTCCCAG<br>CTGTCCTACAGTCCTCAGGACTCTACTCCCTCAGCAGC<br>GTGGTGACCGTGCCCTCCAGCAACTTCGGCACCCAGAC<br>CTACACCTGCAACGTAGATCACAAGCCCAGCAACACCA<br>AGGTGGACAAGACAGTTGAGCGCAAATGTTGTGTCGAG<br>TGCCCACCGTGCCCAGCACCACCTGTGGCAGGACCGTC<br>AGTCTTCCTCTTCCCCCCAAAACCCAAGGACACCCTCA<br>TGATCTCCCGGACCCCTGAGGTCACGTGCGTGGTGGTG<br>GACGTGAGCCACGAAGACCCCGAGGTCCAGTTCAACTG<br>GTACGTGGACGGCGTGGAGGTGCATAATGCCAAGACAA<br>AGCCACGGGAGGAGCAGTTCAACAGCACGTTCCGTGTG<br>GTCAGCGTCCTCACCGTTGTGCACCAGGACTGGCTGAA<br>CGGCAAGGAGTACAAGTGCAAGGTCTCCAACAAAGGCC<br>TCCCAGCCCCCATCGAGAAAACCATCTCCAAAACCAAA<br>GGGCAGCCCCGAGAACCACAGGTGTACACCCTGCCCCC<br>ATCCCGGGAGGAGATGACCAAGAACCAGGTCAGCCTGA<br>CCTGCCTGGTCAAAGGCTTCTACCCCAGCGACATCGCC<br>GTGGAGTGGGAGAGCAATGGGCAGCCGGAGAACAACTA<br>CAAGACCACACCTCCCATGCTGGACTCCGACGGCTCCT<br>TCTTCCTCTACAGCAAGCTCACCGTGGACAAGAGCAGG<br>TGGCAGCAGGGGAACGTCTTCTCATGCTCCGTGATGCA<br>TGAGGCTCTGCACAACCACTACACGCAGAAGAGCCTCT<br>CCCTGTCTCCGGGTAAA</u> |
| 161 | 18E10 (full length wild-type light chain) nucleotide sequence | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCGTACACTTTTGGCCAGGGGA<br>CCAAGCTGGAGATCAAA<u>CGAACTGTGGCTGCACCATCT<br>GTCTTCATCTTCCCGCCATCTGATGAGCAGTTGAAATC<br>TGGAACTGCCTCTGTTGTGTGCCTGCTGAATAACTTCT<br>ATCCCAGAGAGGCCAAAGTACAGTGGAAGGTGGATAAC<br>GCCCTCCAATCGGGTAACTCCCAGGAGAGTGTCACAGA<br>GCAGGACAGCAAGGACAGCACCTACAGCCTCAGCAGCA<br>CCCTGACGCTGAGCAAAGCAGACTACGAGAAACACAAA<br>GTCTACGCCTGCGAAGTCACCCATCAGGGCCTGAGCTC<br>GCCCGTCACAAAGAGCTTCAACAGGGGAGAGTGT</u> |
| 162 | 3C3 (VH) nucleotide sequence | CAGGTGCAACTACAGCAGTGGGGCGCAGGACTGTTGAA<br>GCCTTCGGAGACCCTGTCCCTCACCTGCGCTGTCTATG<br>GTGGGTCCTTCAGTGGTTACTACTGGACCTGGATCCGC<br>CAGCCCCCAGGGAAGGGGCTGGAGTGGATTGGGAAAAT<br>CAATCATAGTGGAAACACCAACTACAACCCGTCCCTCA |

TABLE 2-continued

SEQUENCES

| SEQ ID | Description | Sequence |
|---|---|---|
| | | AGAGTCGAGTCACCATATCAGTAGACACGTCCAAGAAC<br>CAGTTCTCCCTGAAGCTGAGCTCTGTGACCGCCGCGGA<br>CACGGCTGTGTATTACTGTGCGAGACTGGGGGCCTTTG<br>ATGCTTTTGATATCTGGGGCCAAGGGACAATGGTCACC<br>GTCTCTTCA |
| 163 | 3C3 (VL1) nucleotide sequence | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCGTACACTTTTGGCCAGGGGA<br>CCAAGCTGGAGATCAAA |
| 164 | 3C3 (VL2) nucleotide sequence | GAAATTGTGTTGACACAGTCTCCAGCCACCCTGTCTTT<br>GTCTCCAGGGGAAAGAGCCACCCTCTCCTGCAGGGCCA<br>GTCAGGGTGTTAGCAGCTACTTAGCCTGGTACCAGCAG<br>AAACCTGGCCAGGCTCCCAGGCTCCTCATCTATGATGC<br>ATCCAACAGGGCCACTGGCATCCCAGCCAGGTTCAGTG<br>GCAGTGGGCCTGGGACAGACTTCACTCTCACCATCAGC<br>AGCCTAGAGCCTGAAGATTTTGCAGTTTATTACTGTCA<br>GCAGCGTAGCAACTGGCACACTTTTGGCCAGGGGACCA<br>AGCTGGAGATCAAA |
| 165 | 3C3 (full length wild-type heavy chain) nucleotide sequence<br>The sequence encoding the constant region is underlined | CAGGTGCAACTACAGCAGTGGGGCGCAGGACTGTTGAA<br>GCCTTCGGAGACCCTGTCCCTCACCTGCGCTGTCTATG<br>GTGGGTCCTTCAGTGGTTACTACTGGACCTGGATCCGC<br>CAGCCCCCAGGGAAGGGGCTGGAGTGGATTGGGAAAAT<br>CAATcATAGTGGAAAcAccAAcTACAACCCGTCCCTCA<br>AGAGTCGAGTCACCATATCAGTAGACACGTCCAAGAAC<br>CAGTTCTCCCTGAAGCTGAGCTCTGTGACCGCCGCGGA<br>CACGGCTGTGTATTACTGTGCGAGACTGGGGGCCTTTG<br>ATGCTTTTGATATCTGGGGCCAAGGGACAATGGTCACC<br>GTCTCTTCA<u>GCCTCCACCAAGGGCCCATCGGTCTTCCC<br>CCTGGCACCCTCCTCCAAGAGCACCTCTGGGGGCACAG<br>CGGCCCTGGGCTGCCTGGTCAAGGACTACTTCCCCGAA<br>CCGGTGACGGTGTCGTGGAACTCAGGCGCCCTGACCAG<br>CGGCGTGCACACCTTCCCGGCTGTCCTACAGTCCTCAG<br>GACTCTACTCCCTCAGCAGCGTGGTGACCGTGCCCTCC<br>AGCAGCTTGGGCACCCAGACCTACATCTGCAACGTGAA<br>TCACAAGCCCAGCAACACCAAGGTGGACAAGAGAGTTG<br>AGCCCAAATCTTGTGACAAAACTCACACATGCCCACCG<br>TGCCCAGCACCTGAACTCCTGGGGGGACCGTCAGTCTT<br>CCTCTTCCCCCCAAAACCCAAGGACACCCTCATGATCT<br>CCCGGACCCCTGAGGTCACATGCGTGGTGGTGGACGTG<br>AGCCACGAAGACCCTGAGGTCAAGTTCAACTGGTACGT<br>GGACGGCGTGGAGGTGCATAATGCCAAGACAAAGCCGC<br>GGGAGGAGCAGTACAACAGCACGTACCGTGTGGTCAGC<br>GTCCTCACCGTCCTGCACCAGGACTGGCTGAATGGCAA<br>GGAGTACAAGTGCAAGGTCTCCAACAAAGCCCTCCCAG<br>CCCCCATCGAGAAAACCATCTCCAAAGCCAAAGGGCAG<br>CCCCGAGAACCACAGGTGTACACCCTGCCCCCATCCCG<br>GGATGAGCTGACCAAGAACCAGGTCAGCCTGACCTGCC<br>TGGTCAAAGGCTTCTATCCCAGCGACATCGCCGTGGAG<br>TGGGAGAGCAATGGGCAGCCGGAGAACAACTACAAGAC<br>CACGCCTCCCGTGCTGGACTCCGACGGCTCCTTCTTCC<br>TCTACAGCAAGCTCACCGTGGACAAGAGCAGGTGGCAG<br>CAGGGGAACGTCTTCTCATGCTCCGTGATGCATGAGGC<br>TCTGCACAACCACTACACGCAGAAGAGCCTCTCCCTGT<br>CTCCGGGTAAA</u> |
| 166 | 3C3 L1 (full length wild-type light chain) nucleotide sequence<br>The sequence encoding the constant region is underlined | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCGTACACTTTTGGCCAGGGGA<br>CCAAGCTGGAGATCAAA<u>CGAACTGTGGCTGCACCATCT<br>GTCTTCATCTTCCCGCCATCTGATGAGCAGTTGAAATC<br>TGGAACTGCCTCTGTTGTGTGCCTGCTGAATAACTTCT<br>ATCCCAGAGAGGCCAAAGTACAGTGGAAGGTGGATAAC</u> |

TABLE 2-continued

SEQUENCES

| SEQ ID | Description | Sequence |
|---|---|---|
| | | GCCCTCCAATCGGGTAACTCCCAGGAGAGTGTCACAGA<br>GCAGGACAGCAAGGACAGCACCTACAGCCTCAGCAGCA<br>CCCTGACGCTGAGCAAAGCAGACTACGAGAAACACAAA<br>GTCTACGCCTGCGAAGTCACCCATCAGGGCCTGAGCTC<br>GCCCGTCACAAAGAGCTTCAACAGGGGAGAGTGT |
| 167 | 3C3 L2 (full length wild-type light chain) nucleotide sequence<br>The sequence encoding the constant region is underlined | GAAATTGTGTTGACACAGTCTCCAGCCACCCTGTCTTT<br>GTCTCCAGGGGAAAGAGCCACCCTCTCCTGCAGGGCCA<br>GTCAGGGTGTTAGCAGCTACTTAGCCTGGTACCAGCAG<br>AAACCTGGCCAGGCTCCCAGGCTCCTCATCTATGATGC<br>ATCCAACAGGGCCACTGGCATCCCAGCCAGGTTCAGTG<br>GCAGTGGGCCTGGGACAGACTTCACTCTCACCATCAGC<br>AGCCTAGAGCCTGAAGATTTTGCAGTTTATTACTGTCA<br>GCAGCGTAGCAACTGGCACACTTTTGGCCAGGGGACCA<br>AGCTGGAGATCAAACGAACTGTGGCTGCACCATCTGTC<br>TTCATCTTCCCGCCATCTGATGAGCAGTTGAAATCTGG<br>AACTGCCTCTGTTGTGTGCCTGCTGAATAACTTCTATC<br>CCAGAGAGGCCAAAGTACAGTGGAAGGTGGATAACGCC<br>CTCCAATCGGGTAACTCCCAGGAGAGTGTCACAGAGCA<br>GGACAGCAAGGACAGCACCTACAGCCTCAGCAGCACCC<br>TGACGCTGAGCAAAGCAGACTACGAGAAACACAAAGTC<br>TACGCCTGCGAAGTCACCCATCAGGGCCTGAGCTCGCC<br>CGTCACAAAGAGCTTCAACAGGGGAGAGTGT |
| 168 | 2G6 (VH) nucleotide sequence | CAGGTTCAGCTGGTGGAGTCTGGGGGAGGCGTGGTCCA<br>GCCTGGGGGGTCCCTGAGACTCTCCTGTGCAGCGTCTG<br>GATTCATCTTGAGTGACTATGGCATGCACTGGGTCCGC<br>CAGGCTCCAGGCAAGGGACTGGAGTGGGTGACAGTTAT<br>CTGGTATGATGGAAGTAATAAATTCTATGTAGACTCCG<br>TGAAGGGCCGATTCACCATCTCCAGAGACAATTCCAAG<br>AACACGTTGTATCTGCAAATGAACAGCCTGAGAGTCGA<br>GGACACGGCTGTGTATTACTGTGCGAGAGGGGGACGTC<br>TAGCAACAGGTCACTTCTACTACGTTATGGACGTCTGG<br>GGCCAAGGGACCACGGTCACCGTCTCCTCA |
| 169 | 2G6 (VL) nucleotide sequence | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCGTACACTTTTGGCCAGGGGA<br>CCAAGCTGGAGATCAAA |
| 170 | 2G6 (full length wild-type heavy chain) nucleotide sequence<br>The sequence encoding the constant region is underlined | CAGGTTCAGCTGGTGGAGTCTGGGGGAGGCGTGGTCCA<br>GCCTGGGGGGTCCCTGAGACTCTCCTGTGCAGCGTCTG<br>GATTCATCTTGAGTGACTATGGCATGCACTGGGTCCGC<br>CAGGCTCCAGGCAAGGGACTGGAGTGGGTGACAGTTAT<br>CTGGTATGATGGAAGTAATAAATTCTATGTAGACTCCG<br>TGAAGGGCCGATTCACCATCTCCAGAGACAATTCCAAG<br>AACACGTTGTATCTGCAAATGAACAGCCTGAGAGTCGA<br>GGACACGGCTGTGTATTACTGTGCGAGAGGGGGACGTC<br>TAGCAACAGGTCACTTCTACTACGTTATGGACGTCTGG<br>GGCCAAGGGACCACGGTCACCGTCTCCTCAGCCTCCAC<br>CAAGGGCCCATCGGTCTTCCCCCTGGCGCCCTGCTCCA<br>GGAGCACCTCCGAGAGCACAGCGGCCCTGGGCTGCCTG<br>GTCAAGGACTACTTCCCCGAACCGGTGACGGTGTCGTG<br>GAACTCAGGCGCTCTGACCAGCGGCGTGCACACCTTCC<br>CAGCTGTCCTACAGTCCTCAGGACTCTACTCCCTCAGC<br>AGCGTGGTGACCGTGCCCTCCAGCAACTTCGGCACCCA<br>GACCTACACCTGCAACGTAGATCACAAGCCCAGCAACA<br>CCAAGGTGGACAAGACAGTTGAGCGCAAATGTTGTGTC<br>GAGTGCCCACCGTGCCCAGCACCACCTGTGGCAGGACC<br>GTCAGTCTTCCTCTTCCCCCCAAAACCCAAGGACACCC<br>TCATGATCTCCCGGACCCCTGAGGTCACGTGCGTGGTG<br>GTGGACGTGAGCCACGAAGACCCCGAGGTCCAGTTCAA<br>CTGGTACGTGGACGGCGTGGAGGTGCATAATGCCAAGA<br>CAAAGCCACGGGAGGAGCAGTTCAACAGCACGTTCCGT<br>GTGGTCAGCGTCCTCACCGTTGTGCACCAGGACTGGCT<br>GAACGGCAAGGAGTACAAGTGCAAGGTCTCCAACAAAG<br>GCCTCCCAGCCCCCATCGAGAAAACCATCTCCAAAACC<br>AAAGGGCAGCCCCGAGAACCACAGGTGTACACCCTGCC<br>CCCATCCCGGGAGGAGATGACCAAGAACCAGGTCAGCC<br>TGACCTGCCTGGTCAAAGGCTTCTACCCCAGCGACATC |

TABLE 2-continued

SEQUENCES

| SEQ ID | Description | Sequence |
|---|---|---|
| | | GCCGTGGAGTGGGAGAGCAATGGGCAGCCGGAGAACAA
CTACAAGACCACACCTCCCATGCTGGACTCCGACGGCT
CCTTCTTCCTCTACAGCAAGCTCACCGTGGACAAGAGC
AGGTGGCAGCAGGGGAACGTCTTCTCATGCTCCGTGAT
GCATGAGGCTCTGCACAACCACTACACGCAGAAGAGCC
TCTCCCTGTCTCCGGGTAAA |
| 171 | 2G6 (full length wild-type light chain) nucleotide sequence The sequence encoding the constant region is underlined | GACATCCAGATGACCCAGTCTCCATCCTCACTGTCTGC
ATCTGTAGGAGACAGAGTCACCATCACTTGTCGGGCGA
GTCAGGGTATTAGCAGCTGGTTAGCCTGGTATCAGCAG
AAACCAGAGAAAGCCCCTAAGTCCCTGATCTATGCTGC
ATCCAGTTTGCAAAGTGGGGTCCCATCAAGGTTCAGCG
GCAGTGGATCTGGGACAGATTTCACTCTCACCATCAGC
AGCCTGCAGCCTGAAGATTTTGCAACTTATTACTGCCA
ACAGTATAATAGTTACCCGTACACTTTTGGCCAGGGGA
CCAAGCTGGAGATCAAACGAACTGTGGCTGCACCATCT
GTCTTCATCTTCCCGCCATCTGATGAGCAGTTGAAATC
TGGAACTGCCTCTGTTGTGTGCCTGCTGAATAACTTCT
ATCCCAGAGAGGCCAAAGTACAGTGGAAGGTGGATAAC
GCCCTCCAATCGGGTAACTCCCAGGAGAGTGTCACAGA
GCAGGACAGCAAGGACAGCACCTACAGCCTCAGCAGCA
CCCTGACGCTGAGCAAAGCAGACTACGAGAAACACAAA
GTCTACGCCTGCGAAGTCACCCATCAGGGCCTGAGCTC
GCCCGTCACAAAGAGCTTCAACAGGGGAGAGTGT |
| 172 | 8A6 (VH) nucleotide sequence | CAGGTGCAGCTGGTGGAGTCTGGGGGAGGCGTGGTCCA
GCCTGGGAGGTCCCTGAGACTCTCCTGTACAGCGTCTG
GATTCACCTTCAGTAGCTATGGCATGCAGTGGGTCCGC
CAGGCTCCAGGCAAGGGGCTGGAGTGGGTGGCAGTTAT
ATGGTATGAAGGAAGTAATAAATACTATGCAGACTCCG
TGAAGGGCCGATTCACCATCTCCAGAGAAAATTCCAAG
AACACGCTGTATCTGCAAATGAACAGCCTGAGAGCCGA
GGACACGGCTGTGTATTACTGTGCGAGAGGCGGTCTTA
TGGTTCGGGGTCTCTTCTACTACGGTATGGACGTCTGG
GGCCAAGGGACCACGGTCACCGTCTCCTCA |
| 173 | 8A6 (VL) nucleotide sequence | GCCATCCAGTTGACCCAGTCTCCATCCTCCCTGTCTGC
ATCTGTAGGAGACAGAGTCACCATCACTTGCCGGGCAA
GTCAGGGCATTAGCAGTGCTTTAGCCTGGTATCAGCAG
AAACCAGGGAAAGCTCCTAAGTTCCTGATCTATGATGC
CTCCAGTTTGGAAAGTGGGGTCCCATCAAGGTTCAGCG
GCAGTGGATCTGGGACAGATTTCACTCTCACCATCAGC
AGCCTGCAGCCTGAAGATTTTGCAACTTATTACTGTCA
ACAGTTTAATAGTTACCCGTACACTTTTGGCCAGGGGA
CCAAGCTGGAGATCAAA |
| 174 | 8A6 (full length wild-type heavy chain) nucleotide sequence The sequence encoding the constant region is underlined | CAGGTGCAGCTGGTGGAGTCTGGGGGAGGCGTGGTCCA
GCCTGGGAGGTCCCTGAGACTCTCCTGTACAGCGTCTG
GATTCACCTTCAGTAGCTATGGCATGCAGTGGGTCCGC
CAGGCTCCAGGCAAGGGGCTGGAGTGGGTGGCAGTTAT
ATGGTATGAAGGAAGTAATAAATACTATGCAGACTCCG
TGAAGGGCCGATTCACCATCTCCAGAGAAAATTCCAAG
AACACGCTGTATCTGCAAATGAACAGCCTGAGAGCCGA
GGACACGGCTGTGTATTACTGTGCGAGAGGCGGTCTTA
TGGTTCGGGGTCTCTTCTACTACGGTATGGACGTCTGG
GGCCAAGGGACCACGGTCACCGTCTCCTCAGCCTCCAC
CAAGGGCCCATCGGTCTTCCCCCTGGCGCCCTGCTCCA
GGAGCACCTCCGAGAGCACAGCGGCCCTGGGCTGCCTG
GTCAAGGACTACTTCCCCGAACCGGTGACGGTGTCGTG
GAACTCAGGCGCTCTGACCAGCGGCGTGCACACCTTCC
CAGCTGTCCTACAGTCCTCAGGACTCTACTCCCTCAGC
AGCGTGGTGACCGTGCCCTCCAGCAACTTCGGCACCCA
GACCTACACCTGCAACGTAGATCACAAGCCCAGCAACA
CCAAGGTGGACAAGACAGTTGAGCGCAAATGTTGTGTC
GAGTGCCCACCGTGCCCAGCACCACCTGTGGCAGGACC
GTCAGTCTTCCTCTTCCCCCCAAAACCCAAGGACACCC
TCATGATCTCCCGGACCCCTGAGGTCACGTGCGTGGTG
GTGGACGTGAGCCACGAAGACCCCGAGGTCCAGTTCAA
CTGGTACGTGGACGGCGTGGAGGTGCATAATGCCAAGA
CAAAGCCACGGGAGGAGCAGTTCAACAGCACGTTCCGT
GTGGTCAGCGTCCTCACCGTTGTGCACCAGGACTGGCT
GAACGGCAAGGAGTACAAGTGCAAGGTCTCCAACAAAG
GCCTCCCAGCCCCCATCGAGAAAACCATCTCCAAAACC
AAAGGGCAGCCCCGAGAACCACAGGTGTACACCCTGCC
CCCATCCCGGGAGGAGATGACCAAGAACCAGGTCAGCC |

TABLE 2-continued

SEQUENCES

| SEQ ID | Description | Sequence |
|---|---|---|
| | | <u>TGACCTGCCTGGTCAAAGGCTTCTACCCCAGCGACATC</u><br><u>GCCGTGGAGTGGGAGAGCAATGGGCAGCCGGAGAACAA</u><br><u>CTACAAGACCACACCTCCCATGCTGGACTCCGACGGCT</u><br><u>CCTTCTTCCTCTACAGCAAGCTCACCGTGGACAAGAGC</u><br><u>AGGTGGCAGCAGGGGAACGTCTTCTCATGCTCCGTGAT</u><br><u>GCATGAGGCTCTGCACAACCACTACACGCAGAAGAGCC</u><br><u>TCTCCCTGTCTCCGGGTAAA</u> |
| 175 | 8A6 (full length wild-type light chain) nucleotide sequence<br>The sequence encoding the constant region is underlined | GCCATCCAGTTGACCCAGTCTCCATCCTCCCTGTCTGC<br>ATCTGTAGGAGACAGAGTCACCATCACTTGCCGGGCAA<br>GTCAGGGCATTAGCAGTGCTTTAGCCTGGTATCAGCAG<br>AAACCAGGGAAAGCTCCTAAGTTCCTGATCTATGATGC<br>CTCCAGTTTGGAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGTCA<br>ACAGTTTAATAGTTACCCGTACACTTTTGGCCAGGGGA<br>CCAAGCTGGAGATCAAA<u>CGAACTGTGGCTGCACCATCT</u><br><u>GTCTTCATCTTCCCGCCATCTGATGAGCAGTTGAAATC</u><br><u>TGGAACTGCCTCTGTTGTGTGCCTGCTGAATAACTTCT</u><br><u>ATCCCAGAGAGGCCAAAGTACAGTGGAAGGTGGATAAC</u><br><u>GCCCTCCAATCGGGTAACTCCCAGGAGAGTGTCACAGA</u><br><u>GCAGGACAGCAAGGACAGCACCTACAGCCTCAGCAGCA</u><br><u>CCCTGACGCTGAGCAAAGCAGACTACGAGAAACACAAA</u><br><u>GTCTACGCCTGCGAAGTCACCCATCAGGGCCTGAGCTC</u><br><u>GCCCGTCACAAAGAGCTTCAACAGGGGAGAGTGT</u> |
| 176 | 9G7 (VH) nucleotide sequence | GAGGTGCAGCTGGTGGAGTCTGGGGGAGGCTTAGTAAA<br>GCCTGGGGGGTCCCTTAGACTCTCCTGTGCAGCCTCTG<br>GATTCACTTTCAGTACCGTCTGGATGAGCTGGGTCCGC<br>CAGGCTCCAGGGAAGGGGCTGGAGTGGGTTGGCCGTAT<br>TAAAAGCAAACTGATGGTGGGACAACAGACTACGCTG<br>CACCCGTGAAAGGCAGATTCACCATCTCAAGAGATGAT<br>TCAAAAAACACGCTGTATCTGCAAATGAACAGCCTGCA<br>CACCGAGGACACAGCCGTGTATTACTGTACCACAGGGC<br>AGCTGATCCCTTACTCCTACTACTACGGTATGGACGTC<br>TGGGGCCAAGGGACCCTCGGTCACCGTCTCCTCA |
| 177 | 9G7 (VL1) nucleotide sequence | GAAATTGTGTTGACGCAGTCTCCAGGCACCCTGTCTTT<br>GTCTCCAGGGGAAAGAGCCACCCTCTCCTGCAGGGCCA<br>GTCAGAGTGTTAGCAGCAGCTACTTAGCCTGGTACCAG<br>CAGAAACCTGGCCAGGCTCCCAGGCTCCTCATCTATGG<br>TGCATCCAGCAGGGCCACTGGCATCCCAGACAGGTTCA<br>GTGGCAGTGGGTCTGGGACAGACTTCACTCTCACCATC<br>AGCAGACTGGAGCCTGAAGATTTTGCAGTGTATTACTG<br>TCAGCAGTATGGTAGCTCACCGTGGACGTTCGGCCAAG<br>GGACCAAGGTGGAAATCAAA |
| 178 | 9G7 (VL2) nucleotide sequence | GAAATTGTGTTGACGCAGTCTCCAGGCACCCTGTCTTT<br>GTCTCCAGGGGAAAGAGCCACCCTCTCCTGCAGGGCCA<br>GTCAGAGTGTTACCAGCAGCTACTTAGCCTGGTACCAG<br>CAGAAACCTGGCCAGGCTCCCAGGCTCCTCATCTATGG<br>TGCATCCAGCAGGGCCACTGGCATCCCAGAGAGGTTCA<br>GTGGCAGTGGGTCTGGGACAGACTTCACTCTCACCATC<br>AGCAGACTGGAGCCTGAAGATTTTGCAGTGTATTACTG<br>TCAGCAGTATGGTAGCTCACCGATCACCTTCGGCCAAG<br>GGACACGACTGGAGATTAAA |
| 179 | 9G7 (full length wild-type heavy chain) nucleotide sequence<br>The sequence encoding the constant region is underlined | GAGGTGCAGCTGGTGGAGTCTGGGGGAGGCTTAGTAAA<br>GCCTGGGGGGTCCCTTAGACTCTCCTGTGCAGCCTCTG<br>GATTCACTTTCAGTACCGTCTGGATGAGCTGGGTCCGC<br>CAGGCTCCAGGGAAGGGGCTGGAGTGGGTTGGCCGTAT<br>TAAAAGCAAACTGATGGTGGGACAACAGACTACGCTG<br>CACCCGTGAAAGGCAGATTCACCATCTCAAGAGATGAT<br>TCAAAAAACACGCTGTATCTGCAAATGAACAGCCTGCA<br>CACCGAGGACACAGCCGTGTATTACTGTACCACAGGGC<br>AGCTGATCCCTTACTCCTACTACTACGGTATGGACGTC<br>TGGGGCCAAGGGACCCTCGGTCACCGTCTCCTCA<u>GCTTC</u><br><u>CACCAAGGGCCCATCCGTCTTCCCCCTGGCGCCCTGCT</u><br><u>CCAGGAGCACCTCCGAGAGCACAGCCGCCCTGGGCTGC</u><br><u>CTGGTCAAGGACTACTTCCCCGAACCGGTGACGGTGTC</u><br><u>GTGGAACTCAGGCGCCCTGACCAGCGGCGTGCACACCT</u><br><u>TCCCGGCTGTCCTACAGTCCTCAGGACTCTACTCCCTC</u><br><u>AGCAGCGTGGTGACCGTGCCCTCCAGCAGCTTGGGCAC</u><br><u>GAAGACCTACACCTGCAACGTAGATCACAAGCCCAGCA</u><br><u>ACACCAAGGTGGACAAGAGAGTTGAGTCCAAATATGGT</u> |

TABLE 2-continued

SEQUENCES

| SEQ ID | Description | Sequence |
|---|---|---|
| | | <u>CCCCCATGCCCCATCATGCCCAGCACCTGAGTTCCTGGG</u><br><u>GGGACCATCAGTCTTCCTGTTCCCCCCAAAACCCAAGG</u><br><u>ACACTCTCATGATCTCCCGGACCCCTGAGGTCACGTGC</u><br><u>GTGGTGGTGGACGTGAGCCAGGAAGACCCCGAGGTCCA</u><br><u>GTTCAACTGGTACGTGGATGGCGTGGAGGTGCATAATG</u><br><u>CCAAGACAAAGCCGCGGGAGGAGCAGTTCAACAGCACG</u><br><u>TACCGTGTGGTCAGCGTCCTCACCGTCCTGCACCAGGA</u><br><u>CTGGCTGAACGGCAAGGAGTACAAGTGCAAGGTCTCCA</u><br><u>ACAAAGGCCTCCCGTCCTCCATCGAGAAAACCATCTCC</u><br><u>AAAGCCAAAGGGCAGCCCCGAGAGCCACAGGTGTACAC</u><br><u>CCTGCCCCCATCCCAGGAGGAGATGACCAAGAACCAGG</u><br><u>TCAGCCTGACCTGCCTGGTCAAAGGCTTCTACCCCAGC</u><br><u>GACATCGCCGTGGAGTGGGAGAGCAATGGGCAGCCGGA</u><br><u>GAACAACTACAAGACCACGCCTCCCGTGCTGGACTCCG</u><br><u>ACGGCTCCTTCTTCCTCTACAGCAGGCTAACCGTGGAC</u><br><u>AAGAGCAGGTGGCAGGAGGGGAATGTCTTCTCATGCTC</u><br><u>CGTGATGCATGAGGCTCTGCACAACCACTACACACAGA</u><br><u>GAGCCTCTCCCTGTCTCTGGGTAAA</u> |
| 180 | 9G7 L2 (full length wild-type light chain) nucleotide sequence<br>The sequence encoding the constant region is underlined | GAAATTGTGTTGACGCAGTCTCCAGGCACCCTGTCTTT<br>GTCTCCAGGGGAAAGAGCCACCCTCTCCTGCAGGGCCA<br>GTCAGAGTGTTACCAGCAGCTACTTAGCCTGGTACCAG<br>CAGAAACCTGGCCAGGCTCCCAGGCTCCTCATCTATGG<br>TGCATCCAGCAGGGCCACTGGCATCCCAGAGAGGTTCA<br>GTGGCAGTGGGTCTGGGACAGACTTCACTCTCACCATC<br>AGCAGACTGGAGCCTGAAGATTTTGCAGTGTATTACTG<br>TCAGCAGTATGGTAGCTCACCGATCACCTTCGGCCAAG<br>GGACACGACTGGAGATTAAA<u>CGAACTGTGGCTGCACCA</u><br><u>TCTGTCTTCATCTTCCCGCCATCTGATGAGCAGTTGAA</u><br><u>ATCTGGAACTGCCTCTGTTGTGTGCCTGCTGAATAACT</u><br><u>TCTATCCCAGAGAGGCCAAAGTACAGTGGAAGGTGGAT</u><br><u>AACGCCCTCCAATCGGGTAACTCCCAGGAGAGTGTCAC</u><br><u>AGAGCAGGACAGCAAGGACAGCACCTACAGCCTCAGCA</u><br><u>GCACCCTGACGCTGAGCAAAGCAGACTACGAGAAACAC</u><br><u>AAAGTCTACGCCTGCGAAGTCACCCATCAGGGCCTGAG</u><br><u>CTCGCCCGTCACAAAGAGCTTCAACAGGGGAGAGTGT</u> |
| 181 | 9G7 L1 (full length wild-type light chain) nucleotide sequence<br>The sequence encoding the constant region is underlined | GAAATTGTGTTGACGCAGTCTCCAGGCACCCTGTCTTT<br>GTCTCCAGGGGAAAGAGCCACCCTCTCCTGCAGGGCCA<br>GTCAGAGTGTTAGCAGCAGCTACTTAGCCTGGTACCAG<br>CAGAAACCTGGCCAGGCTCCCAGGCTCCTCATCTATGG<br>TGCATCCAGCAGGGCCACTGGCATCCCAGACAGGTTCA<br>GTGGCAGTGGGTCTGGGACAGACTTCACTCTCACCATC<br>AGCAGACTGGAGCCTGAAGATTTTGCAGTGTATTACTG<br>TCAGCAGTATGGTAGCTCACCGTGGACGTTCGGCCAAG<br>GGACCAAGGTGGAAATCAAA<u>CGAACTGTGGCTGCACCA</u><br><u>TCTGTCTTCATCTTCCCGCCATCTGATGAGCAGTTGAA</u><br><u>ATCTGGAACTGCCTCTGTTGTGTGCCTGCTGAATAACT</u><br><u>TCTATCCCAGAGAGGCCAAAGTACAGTGGAAGGTGGAT</u><br><u>AACGCCCTCCAATCGGGTAACTCCCAGGAGAGTGTCAC</u><br><u>AGAGCAGGACAGCAAGGACAGCACCTACAGCCTCAGCA</u><br><u>GCACCCTGACGCTGAGCAAAGCAGACTACGAGAAACAC</u><br><u>AAAGTCTACGCCTGCGAAGTCACCCATCAGGGCCTGAG</u><br><u>CTCGCCCGTCACAAAGAGCTTCAACAGGGGAGAGTGT</u> |
| 182 | 14E3 (VH) nucleotide sequence | CAGGTGCAGCTACAGCAGTGGGGCGCAGGACTGTTGAA<br>GCCTTCGGAGACCCTGTCCCTCACCTGCGCTGTCTATG<br>GTGGGTCCTTCAGTGGTTACTACTGGAGCTGGATCCGC<br>CAGCCCCCAGGGAAGGGGCTGGAGTGGATTGGAGAAAT<br>CAATCATAGTGGAAACACCTACTACAACCCGTCCCTCA<br>AGAGTCGCGTCACCATATCAGTAGACACGTCCAAGAAC<br>CAGTTATCCCTGAAGCTGAGCTCTGTGACCGCCGCGGA<br>CACGGCTGTGTATTACTGTGCGAGATTTGGGAGTAATG<br>ATGCTTTTGATATCTGGGGCCAAGGGACAATGGTCACC<br>GTCTCTTCA |
| 183 | 14E3 (VL) nucleotide sequence | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGTGGATCTGGGACAGATTTCACTCTCACCATCAGC<br>AGCCTGCAGCCTGAAGATTTTGCAACTTATTACTGCCA<br>ACAGTATAATAGTTACCCTCCGACGTTCGGCCAAGGGA<br>CCAAGGTGGAAATCAAA |

TABLE 2-continued

SEQUENCES

| SEQ ID | Description | Sequence |
|---|---|---|
| 184 | 14E3 (full length wild-type heavy chain) nucleotide sequence<br>The sequence encoding the constant region is underlined | CAGGTGCAGCTACAGCAGTGGGGCGCAGGACTGTTGAA<br>GCCTTCGGAGACCCTGTCCCTCACCTGCGCTGTCTATG<br>GTGGGTCCTTCAGTGGTTACTACTGGAGCTGGATCCGC<br>CAGCCCCCAGGGAAGGGGCTGGAGTGGATTGGAGAAAT<br>CAATcATAGTGGAAACACCTACTACAACCCGTCCCTCA<br>AGAGTCGCGTCACCATATCAGTAGACACGTCCAAGAAC<br>CAGTTATCCCTGAAGCTGAGCTCTGTGACCGCCGCGGA<br>CACGGCTGTGTATTACTGTGCGAGATTTGGGAGTAATG<br>ATGCTTTTGATATCTGGGGCCAAGGGACAATGGTCACC<br>GTCTCTTCA<u>GCCTCCACCAAGGGCCCATCGGTCTTCCC<br>CCTGGCACCCTCCTCCAAGAGCACCTCTGGGGGCACAG<br>CGGCCCTGGGCTGCCTGGTCAAGGACTACTTCCCCGAA<br>CCGGTGACGGTGTCGTGGAACTCAGGCGCCCTGACCAG<br>CGGCGTGCACACCTTCCCGGCTGTCCTACAGTCCTCAG<br>GACTCTACTCCCTCAGCAGCGTGGTGACCGTGCCCTCC<br>AGCAGCTTGGGCACCCAGACCTACATCTGCAACGTGAA<br>TCACAAGCCCAGCAACACCAAGGTGGACAAGAGAGTTG<br>AGCCCAAATCTTGTGACAAAACTCACACATGCCCACCG<br>TGCCCAGCACCTGAACTCCTGGGGGGACCGTCAGTCTT<br>CCTCTTCCCCCCAAAACCCAAGGACACCCTCATGATCT<br>CCCGGACCCCTGAGGTCACATGCGTGGTGGTGGACGTG<br>AGCCACGAAGACCCTGAGGTCAAGTTCAACTGGTACGT<br>GGACGGCGTGGAGGTGCATAATGCCAAGACAAAGCCGC<br>GGGAGGAGCAGTACAACAGCACGTACCGTGTGGTCAGC<br>GTCCTCACCGTCCTGCACCAGGACTGGCTGAATGGCAA<br>GGAGTACAAGTGCAAGGTCTCCAACAAAGCCCTCCCAG<br>CCCCCATCGAGAAAACCATCTCCAAAGCCAAAGGGCAG<br>CCCCGAGAACCACAGGTGTACACCCTGCCCCCATCCCG<br>GGATGAGCTGACCAAGAACCAGGTCAGCCTGACCTGCC<br>TGGTCAAAGGCTTCTATCCCAGCGACATCGCCGTGGAG<br>TGGGAGAGCAATGGGCAGCCGGAGAACAACTACAAGAC<br>CACGCCTCCCGTGCTGGACTCCGACGGCTCCTTCTTCC<br>TCTACAGCAAGCTCACCGTGGACAAGAGCAGGTGGCAG<br>CAGGGGAACGTCTTCTCATGCTCCGTGATGCATGAGGC<br>TCTGCACAACCACTACACGCAGAAGAGCCTCTCCCTGT<br>CTCCGGGTAAA</u> |
| 185 | 14E3 (full length wild-type light chain) nucleotide sequence<br>The sequence encoding the constant region is underlined | GACATCCAGATGACCCAGTCTCCATCCTCACTGTCTGC<br>ATCTGTAGGAGACAGAGTCACCATCACTTGTCGGGCGA<br>GTCAGGGTATTAGCAGCTGGTTAGCCTGGTATCAGCAG<br>AAACCAGAGAAAGCCCCTAAGTCCCTGATCTATGCTGC<br>ATCCAGTTTGCAAAGTGGGGTCCCATCAAGGTTCAGCG<br>GCAGtGGATCTGGGACAGATTTCACTCTCACCATCAGC<br>AGCCTGCAGCCTGAAGATTTTGCAACTTATTACTGCCA<br>ACAGTATAATAGTTACCCTCCGACGTTCGGCCAAGGGA<br>CCAAGGTGGAAATCAAA<u>CGAACTGTGGCTGCACCATCT<br>GTCTTCATCTTCCCGCCATCTGATGAGCAGTTGAAATC<br>TGGAACTGCCTCTGTTGTGTGCCTGCTGAATAACTTCT<br>ATCCCAGAGAGGCCAAAGTACAGTGGAAGGTGGATAAC<br>GCCCTCCAATCGGGTAACTCCCAGGAGAGTGTCACAGA<br>GCAGGACAGCAAGGACAGCACCTACAGCCTCAGCAGCA<br>CCCTGACGCTGAGCAAAGCAGACTACGAGAAACACAAA<br>GTCTACGCCTGCGAAGTCACCCATCAGGGCCTGAGCTC<br>GCCCGTCACAAAGAGCTTCAACAGGGGAGAGTGT</u> |
| 186 | 19H8 (VH) nucleotide sequence | CAGGTGCAGCTGGTGGAGTCTGGGGGAGGCGTGGTCCA<br>GCCTGGGAGGTCCCTGAGACTCTCCTGTGCAGCGTCTG<br>GATTCACCTTCAGTAACTATGGCATGCACTGGGTCCGC<br>CAGGCTCCAGGCAAGGGGCTGGAGTGGATGGCAGTTAT<br>ATGGTATGGTGGAAGTAATAAATTCTATGCAGACTCCG<br>TGAAGGGCCGATTCACCATCTCCAGAGACAATTCCAAG<br>AACTCGCTGTCTCTGCAAATGAACAGCCTGAGAGCCGA<br>GGACACGGCTGTGTATTACTGTGCGAGAGGGGGGGCTA<br>TGGTTCGGGGAGTCTACTACTACGGTATGGACGTCTGG<br>GGCCAAGGGACCACGGTCAC CGTCTCCTCA |
| 187 | 19H8 (VL1) nucleotide sequence | GCCATCCAGTTGACCCAGTCTCCATCCTCCCTGTCTGC<br>ATCTGTAGGAGACAGAGTCACCATCACTTGCCGGGCAA<br>GTCAGGGCATTAGCAGTGCTTTAGCCTGGTATCAGCAG<br>AAACCAGGGAAAGCTCCTAAGTTCCTGATCTATGATGC<br>CTCCAGTTTGGAAAGTGGGGTCCCATCAAGGTTCAGCG<br>GCAGTGGATCTGGGACAGATTTCACTCTCACCATCAGC |

TABLE 2-continued

SEQUENCES

| SEQ ID | Description | Sequence |
|---|---|---|
| | | AGCCTGCAGCCTGAAGATTTTGCAACTTATTACTGTCA ACAGTTTAATAGTTACCCTCAGACGTTCGGCCAAGGGA CCAAGGTGGAAATCAAA |
| 188 | 19H8 (VL2) nucleotide sequence | GAAATTGTGTTGACACAGTCTCCAGCCACCCTGTCTTT GTCTCCAGGGGAAAGAGCCACCCTCTCCTGCAGGGCCA GTCAGAGTGTTAGCAGCTACTTAGCCTGGTACCAACAG AAACCTGGCCAGGCTCCCAGGCTCCTCATCTATGATGC ATCCAACAGGGCCACTGGCATCCCAGCCAGGTTCAGTG GCAGTGGGTCTGGGACAGACTTCACTCTCACCATCAGC AGCCTAGAGCCTGAAGATTTTGCAGTTTATTACTGTCA GCAGCGTAGCAACTGGCCGCTCACTTTCGGCGGAGGGA CCAAGGTGGAGATCAAA |
| 189 | 19H8 (full length wild-type heavy chain) nucleotide sequence<br>The sequence encoding the constant region is underlined | CAGGTGCAGCTGGTGGAGTCTGGGGGAGGCGTGGTCCA GCCTGGGAGGTCCCTGAGACTCTCCTGTGCAGCGTCTG GATTCACCTTCAGTAACTATGGCATGCACTGGGTCCGC CAGGCTCCAGGCAAGGGGCTGGAGTGGATGGCAGTTAT ATGGTATGGTGGAAGTAATAAATTCTATGCAGACTCCG TGAAGGGCCGATTCACCATCTCCAGAGACAATTCCAAG AACTCGCTGTCTCTGCAAATGAACAGCCTGAGAGCCGA GGACACGGCTGTGTATTACTGTGCGAGAGGGGGGGCTA TGGTTCGGGGAGTCTACTACTACGGTATGGACGTCTGG GGCCAAGGGACCACGGTCACCGTCTCCTCAGCCTCCAC CAAGGGCCCATCGGTCTTCCCCCTGGCGCCCTGCTCCA GGAGCACCTCCGAGAGCACAGCGGCCCTGGGCTGCCTG GTCAAGGACTACTTCCCCGAACCGGTGACGGTGTCGTG GAACTCAGGCGCTCTGACCAGCGGCGTGCACACCTTCC CAGCTGTCCTACAGTCCTCAGGACTCTACTCCCTCAGC AGCGTGGTGACCGTGCCCTCCAGCAACTTCGGCACCCA GACCTACACCTGCAACGTAGATCACAAGCCCAGCAACA CCAAGGTGGACAAGACAGTTGAGCGCAAATGTTGTGTC GAGTGCCCACCGTGCCCAGCACCACCTGTGGCAGGACC GTCAGTCTTCCTCTTCCCCCCAAAACCCAAGGACACCC TCATGATCTCCCGGACCCCTGAGGTCACGTGCGTGGTG GTGGACGTGAGCCACGAAGACCCCGAGGTCCAGTTCAA CTGGTACGTGGACGGCGTGGAGGTGCATAATGCCAAGA CAAAGCCACGGGAGGAGCAGTTCAACAGCACGTTCCGT GTGGTCAGCGTCCTCACCGTTGTGCACCAGGACTGGCT GAACGGCAAGGAGTACAAGTGCAAGGTCTCCAACAAAG GCCTCCCAGCCCCCATCGAGAAAACCATCTCCAAAACC AAAGGGCAGCCCCGAGAACCACAGGTGTACACCCTGCC CCCATCCCGGGAGGAGATGACCAAGAACCAGGTCAGCC TGACCTGCCTGGTCAAAGGCTTCTACCCCAGCGACATC GCCGTGGAGTGGGAGAGCAATGGGCAGCCGGAGAACAA CTACAAGACCACACCTCCCATGCTGGACTCCGACGGCT CCTTCTTCCTCTACAGCAAGCTCACCGTGGACAAGAGC AGGTGGCAGCAGGGGAACGTCTTCTCATGCTCCGTGAT GCATGAGGCTCTGCACAACCACTACACGCAGAAGAGCC TCTCCCTGTCTCCGGGTAAA |
| 190 | 19H8 L1 (full length wild-type light chain) nucleotide sequence<br>The sequence encoding the constant region is underlined | GCCATCCAGTTGACCCAGTCTCCATCCTCCCTGTCTGC ATCTGTAGGAGACAGAGTCACCATCACTTGCCGGGCAA GTCAGGGCATTAGCAGTGCTTTAGCCTGGTATCAGCAG AAACCAGGGAAAGCTCCTAAGTTCCTGATCTATGATGC CTCCAGTTTGGAAAGTGGGGTCCCATCAAGGTTCAGCG GCAGTGGATCTGGGACAGATTTCACTCTCACCATCAGC AGCCTGCAGCCTGAAGATTTTGCAACTTATTACTGTCA ACAGTTTAATAGTTACCCTCAGACGTTCGGCCAAGGGA CCAAGGTGGAAATCAAA<u>CGAACTGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAAC GCCCTCCAATCGGGTAACTCCCAGGAGAGTGTCACAGA GCAGGACAGCAAGGACAGCACCTACAGCCTCAGCAGCA CCCTGACGCTGAGCAAAGCAGACTACGAGAAACACAAA GTCTACGCCTGCGAAGTCACCCATCAGGGCCTGAGCTC GCCCGTCACAAAGAGCTTCAACAGGGGAGAGTGT</u> |
| 191 | 19H8 L2 (full length wild-type light chain) nucleotide sequence<br>The sequence encoding the constant region is underlined | GAAATTGTGTTGACACAGTCTCCAGCCACCCTGTCTTT GTCTCCAGGGGAAAGAGCCACCCTCTCCTGCAGGGCCA GTCAGAGTGTTAGCAGCTACTTAGCCTGGTACCAACAG AAACCTGGCCAGGCTCCCAGGCTCCTCATCTATGATGC ATCCAACAGGGCCACTGGCATCCCAGCCAGGTTCAGTG GCAGTGGGTCTGGGACAGACTTCACTCTCACCATCAGC |

TABLE 2-continued

SEQUENCES

| SEQ ID | Description | Sequence |
|---|---|---|
| | | AGCCTAGAGCCTGAAGATTTTGCAGTTTATTACTGTCA GCAGCGTAGCAACTGGCCGCTCACTTTCGGCGGAGGGA CCAAGGTGGAGATCAAACGAACTGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAAC GCCCTCCAATCGGGTAACTCCCAGGAGAGTGTCACAGA GCAGGACAGCAAGGACAGCACCTACAGCCTCAGCAGCA CCCTGACGCTGAGCAAAGCAGACTACGAGAAACACAAA GTCTACGCCTGCGAAGTCACCCATCAGGGCCTGAGCTC GCCCGTCACAAAGAGCTTCAACAGGGGAGAGTGT |
| 192 | VH 3-33 (28F3, 18E10, 19D3, 2G6, 8A6, 19H8) | QVQLVESGGGVVQPGRSLRLSCAASGFTFSSYGMHWVR QAPGKGLEWVAVIWYDGSNKYYADSVKGRFTISRDNSK NTLYLQMNSLRAEDTAVYYCAR |
| 193 | VH 3-10 (28F3, 8A6) | MVRG |
| 194 | VH 3-10 (9G7) | YYYG |
| 195 | VH 3-10 (19H8) | YYY |
| 196 | VH JH6 (28F3, 19H8) | YYYGMDVWGQGTTVTVSS |
| 197 | VH JH6 (18E10, 2G6, 8A6) | YYGMDVWGQGTTVTVSS |
| 198 | VH JH6 (19D3, 9G7) | YYYYYGMDVWGQGTTVTVSS |
| 199 | VH 6-19 (18E10) | IAVA |
| 200 | VH 3-16 (19D3) | DY |
| 201 | VH 4-34 (3C3, 14E3) | QVQLQQWGAGLLKPSETLSLTCAVYGGSFSGYYWSWIR QPPGKGLEWIGEINHSGSTNYNPSLKSRVTISVDTSKN QFSLKLSSVTAADTAVYYCAR |
| 202 | VH JH3 (3C3, 14E3) | DAFDIWGQGTMVTVSS |
| 203 | VH 3-15 (9G7) | EVQLVESGGGLVKPGGSLRLSCAASGFTFSNAWMSWVR QAPGKGLEWVGRIKSKTDGGTTDYAAPVKGRFTISRDD SKNTLYLQMNSLKTEDTAVYYCTT |
| 204 | VL L18 (28F3, 8A6, 19H8VK1) | AIQLTQSPSSLSASVGDRVTITCRASQGISSALAWYQQ KPGKAPKLLIYDASSLESGVPSRFSGSGSGTDFTLTIS SLQPEDFATYYCQQFNNY |
| 205 | VL JK2 (28F3, 18E10, 19D3, 3C3VK1, 8A6, 2G6) | YTFGQGTKLEIK |
| 206 | VL JK2 (3C3VK2) | TFGQGTKLEIK |
| 207 | VL L15 (18E10, 19D3, 3C3VK1, 2G6, 14E3) | DIQMTQSPSSLSASVGDRVTITCRASQGISSWLAWYQQ KPEKAPKSLIYAASSLQSGVPSRFSGSGSGTDFTLTIS SLQPEDFATYYCQQYNSY |
| 208 | VL L20 (3C3VK2) | EIVLTQSPATLSLSPGERATLSCRASQGVSSYLAWYQQ KPGQAPRLLIYDASNRATGIPARFSGSGPGTDFTLTIS SLEPEDFAVYYCQQRSNW |
| 209 | VL A27 (9G7VK1, 9G7VK2) | EIVLTQSPGTLSLSPGERATLSCRASQSVSSSYLAWYQ QKPGQAPRLLIYGASSRATGIPDRFSGSGSGTDFTLTI SRLEPEDFAVYYCQQYGSS |
| 210 | VL JK1 (9G7VK1) | WTFGQGTKVEIK |
| 211 | VL JK1 (14E3, 19H8VK1) | TFGQGTKVEIK |
| 212 | VL JK5 (9G7VK2) | ITFGQGTRLEIK |
| 213 | VL L6 (19H8VK2) | EIVLTQSPATLSLSPGERATLSCRASQSVSSYLAWYQQ KPGQAPRLLIYDASNRATGIPARFSGSGSGTDFTLTIS SLEPEDFAVYYCQQRSNW |
| 214 | VL JK4 (19H8VK2) | LTFGGGTKVEIK |

TABLE 2-continued

SEQUENCES

| SEQ ID | Description | Sequence |
|---|---|---|
| 215 | GITR epitope | QRPTGGPGCGPGRLLLGTGTDARCCRVHTTRCCRDYPGE |
| 216 | GITR epitope | QRPTGGPGCGPGRLLLGTGT |
| 217 | GITR epitope (region 1) | PTGGPGCGPGRLLLGTGT |
| 218 | GITR epitope (region 2) | CRDYPGEE |
| 219 | Peptide linker | PVGVV |
| 220 | Heavy chain C-terminus | LSPGK |
| 221 | G2 constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| 222 | G2(C219S) constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| 223 | G2.g1 modified constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLEPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 224 | G2.g1.1 modified constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLEPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 225 | G2(C219S).g1 modified constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLEPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 226 | G2(C219S).g1.1 modified constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLEPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 15 | 28F3 (VH + G2) or 28F3-IgG2 | SEQ ID NO: 15 |

TABLE 2-continued

SEQUENCES

| SEQ ID | Description | Sequence |
|---|---|---|
| 227 | 28F3 (VH + G2(C219S)) or 28F3-IgG2-C219S | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLFPPKPKDTLMISRTPEVTCVV VDVSHEDPEVQFNWYVDGVEVHNAKTKPREEQFNSTFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPG |
| 228 | 28F3 (VH + G2.g1) or 28F3-IgG2-IgG1 | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 229 | 28F3 (VH + G2.g1.1) or 28F3-IgG2-IgG1.1 | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 230 | 28F3 (VH + G2(C219S).g1) or 28F3-IgG2-C219S-IgG1 | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 231 | 28F3 (VH G2(C219S).g1.1 or 28F3-IgG2-C219S-IgG1.1 | QVQLVESGGGVVQPGRSLRLSCAASGFTFSSYGMHWVR QAPGKGLEWVAVIWYEGSNKYYADSVKGRFTISRDNSK NTLYLQMNSLRAEDTAVYYCARGGSMVRGDYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLEPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 28 | 19D3 (VH + G2) or 19D3-IgG2 | SEQ ID NO: 28 |
| 232 | 19D3 (VH + G2(C219S)) or 19D3-IgG2-C219S | QVQLVESGGGVVQPGRSLRLSCAASGFTFSSYGFHWVR QAPGKGLEWVAVIWYAGSNKFYADSVKGRFTISRDNSK NTLYLQMNSLRAEDTAVYYCARGGQLDYYYYYVMDVWG QGTTVTVSSASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKSCVE |

TABLE 2-continued

SEQUENCES

| SEQ ID | Description | Sequence |
|---|---|---|
| | | CPPCPAPPVAGPSVFLEPPKPKDTLMISRTPEVTCVVV
DVSHEDPEVQFNWYVDGVEVHNAKTKPREEQFNSTFRV
VSVLTVVHQDWLNGKEYKCKVSNKGLPAPIEKTISKTK
GQPREPQVYTLPPSREEMTKNQVSLTCLVKGFYPSDIA
VEWESNGQPENNYKTTPPMLDSDGSFFLYSKLTVDKSR
WQQGNVFSCSVMHEALHNHYTQKSLSLSPG |
| 233 | 19D3 (VH + G2.g1) or
19D3-IgG2-IgG1 | QVQLVESGGGVVQPGRSLRLSCAASGFTFSSYGFHWVR
QAPGKGLEWVAVIWYAGSNKFYADSVKGRFTISRDNSK
NTLYLQMNSLRAEDTAVYYCARGGQLDYYYYYVMDVWG
QGTTVTVSSASTKGPSVFPLAPCSRSTSESTAALGCLV
KDYFPEPVTVSWNSGALTSGVHTFPAVLQSSGLYSLSS
VVTVPSSNFGTQTYTCNVDHKPSNTKVDKTVERKCCVE
CPPCPAPELLGGPSVFLEPPKPKDTLMISRTPEVTCVV
VDVSHEDPEVKFNWYVDGVEVHNAKTKPREEQYNSTYR
VVSVLTVLHQDWLNGKEYKCKVSNKALPAPIEKTISKA
KGQPREPQVYTLPPSREEMTKNQVSLTCLVKGFYPSDI
AVEWESNGQPENNYKTTPPVLDSDGSFFLYSKLTVDKS
RWQQGNVFSCSVMHEALHNHYTQKSLSLSPG |
| 234 | 19D3 (VH + G2.g1.1) or
19D3-IgG2-IgG1.1 | QVQLVESGGGVVQPGRSLRLSCAASGFTFSSYGFHWVR
QAPGKGLEWVAVIWYAGSNKFYADSVKGRFTISRDNSK
NTLYLQMNSLRAEDTAVYYCARGGQLDYYYYYVMDVWG
QGTTVTVSSASTKGPSVFPLAPCSRSTSESTAALGCLV
KDYFPEPVTVSWNSGALTSGVHTFPAVLQSSGLYSLSS
VVTVPSSNFGTQTYTCNVDHKPSNTKVDKTVERKCCVE
CPPCPAPPVAGPSVFLEPPKPKDTLMISRTPEVTCVVV
DVSHEDPEVKFNWYVDGVEVHNAKTKPREEQYNSTYRV
VSVLTVLHQDWLNGKEYKCKVSNKALPSSIEKTISKAK
GQPREPQVYTLPPSREEMTKNQVSLTCLVKGFYPSDIA
VEWESNGQPENNYKTTPPVLDSDGSFFLYSKLTVDKSR
WQQGNVFSCSVMHEALHNHYTQKSLSLSPG |
| 235 | 19D3 (VH + G2(C219S).g1) or
19D3-IgG2-C219S-IgG1 | QVQLVESGGGVVQPGRSLRLSCAASGFTFSSYGFHWVR
QAPGKGLEWVAVIWYAGSNKFYADSVKGRFTISRDNSK
NTLYLQMNSLRAEDTAVYYCARGGQLDYYYYYVMDVWG
QGTTVTVSSASTKGPSVFPLAPCSRSTSESTAALGCLV
KDYFPEPVTVSWNSGALTSGVHTFPAVLQSSGLYSLSS
VVTVPSSNFGTQTYTCNVDHKPSNTKVDKTVERKSCVE
CPPCPAPELLGGPSVFLFPPKPKDTLMISRTPEVTCVV
VDVSHEDPEVKFNWYVDGVEVHNAKTKPREEQYNSTYR
VVSVLTVLHQDWLNGKEYKCKVSNKALPAPIEKTISKA
KGQPREPQVYTLPPSREEMTKNQVSLTCLVKGFYPSDI
AVEWESNGQPENNYKTTPPVLDSDGSFFLYSKLTVDKS
RWQQGNVFSCSVMHEALHNHYTQKSLSLSPG |
| 236 | 19D3 (VH G2(C219S).g1.1) or
19D3-IgG2-C219S-IgG1.1 | QVQLVESGGGVVQPGRSLRLSCAASGFTFSSYGFHWVR
QAPGKGLEWVAVIWYAGSNKFYADSVKGRFTISRDNSK
NTLYLQMNSLRAEDTAVYYCARGGQLDYYYYYVMDVWG
QGTTVTVSSASTKGPSVFPLAPCSRSTSESTAALGCLV
KDYFPEPVTVSWNSGALTSGVHTFPAVLQSSGLYSLSS
VVTVPSSNFGTQTYTCNVDHKPSNTKVDKTVERKSCVE
CPPCPAPPVAGPSVFLFPPKPKDTLMISRTPEVTCVVV
DVSHEDPEVKFNWYVDGVEVHNAKTKPREEQYNSTYRV
VSVLTVLHQDWLNGKEYKCKVSNKALPSSIEKTISKAK
GQPREPQVYTLPPSREEMTKNQVSLTCLVKGFYPSDIA
VEWESNGQPENNYKTTPPVLDSDGSFFLYSKLTVDKSR
WQQGNVFSCSVMHEALHNHYTQKSLSLSPG |
| 41 | 18E10 (VH + G2) or
18E10-IgG2 | SEQ ID NO: 41 |
| 237 | 18E10 (VH + G2(C219S)) or
18E10-IgG2-C219S | QVQLVESGGGVVQPGRSLRLSCAASGFTFSSYGMHWVR
QAPGKGLEWVAVIWYAGSNKYYADSVKGRFTISRDNSK
NTLYLQMNSLRAEDTAVYYCARGGRIAVAFYYSMDVWG
QGTTVTVSSASTKGPSVFPLAPCSRSTSESTAALGCLV
KDYFPEPVTVSWNSGALTSGVHTFPAVLQSSGLYSLSS
VVTVPSSNFGTQTYTCNVDHKPSNTKVDKTVERKSCVE
CPPCPAPPVAGPSVFLFPPKPKDTLMISRTPEVTCVVV
DVSHEDPEVQFNWYVDGVEVHNAKTKPREEQFNSTFRV
VSVLTVVHQDWLNGKEYKCKVSNKGLPAPIEKTISKTK
GQPREPQVYTLPPSREEMTKNQVSLTCLVKGFYPSDIA
VEWESNGQPENNYKTTPPMLDSDGSFFLYSKLTVDKSR
WQQGNVFSCSVMHEALHNHYTQKSLSLSPG |

TABLE 2-continued

SEQUENCES

| SEQ ID | Description | Sequence |
|---|---|---|
| 238 | 18E10 (VH + G2.g1) or 18E10-IgG2-IgG1 | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKCCVE CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 239 | 18E10 (VH + G2.g1.1) or 18E10-IgG2-IgG1.1 | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKCCVE CPPCPAPPVAGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPSSIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPG |
| 240 | 18E10 (VH G2(C219S).g1) or 18E10-IgG2-C219S-IgG1 | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKSCVE CPPCPAPELLGGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPAPIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 241 | 18E10 (VH G2(C219S).g1.1) or 18E10-IgG2-C219S-IgG1.1 | QVQLVESGGGVVQPGRSLRLSCAASGFTFSSYGMHWVR QAPGKGLEWVAVIWYAGSNKYYADSVKGRFTISRDNSK NTLYLQMNSLRAEDTAVYYCARGGRIAVAFYYSMDVWG QGTTVTVSSASTKGPSVFPLAPCSRSTSESTAALGCLV KDYFPEPVTVSWNSGALTSGVHTFPAVLQSSGLYSLSS VVTVPSSNFGTQTYTCNVDHKPSNTKVDKTVERKSCVE CPPCPAPPVAGPSVFLFPPKPKDTLMISRTPEVTCVVV DVSHEDPEVKFNWYVDGVEVHNAKTKPREEQYNSTYRV VSVLTVLHQDWLNGKEYKCKVSNKALPSSIEKTISKAK GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPG |
| 242 | 3C3 (VH + G2) or 3C3-IgG2 | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PPVAGPSVFLFPPKPKDTLMISRTPEVTCVVVDVSHED PEVQFNWYVDGVEVHNAKTKPREEQFNSTFRVVSVLTV VHQDWLNGKEYKCKVSNKGLPAPIEKTISKTKGQPREP QVYTLPPSREEMTKNQVSLTCLVKGFYPSDIAVEWESN GQPENNYKTTPPMLDSDGSFFLYSKLTVDKSRWQQGNV FSCSVMHEALHNHYTQKSLSLSPG |
| 243 | 3C3 (VH + G2(C219S)) or 3C3-IgG2-C219S | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA PPVAGPSVFLFPPKPKDTLMISRTPEVTCVVVDVSHED PEVQFNWYVDGVEVHNAKTKPREEQFNSTFRVVSVLTV VHQDWLNGKEYKCKVSNKGLPAPIEKTISKTKGQPREP QVYTLPPSREEMTKNQVSLTCLVKGFYPSDIAVEWESN |

TABLE 2-continued

SEQUENCES

| SEQ ID | Description | Sequence |
|---|---|---|
| | | GQPENNYKTTPPMLDSDGSFFLYSKLTVDKSRWQQGNV FSCSVMHEALHNHYTQKSLSLSPG |
| 244 | 3C3 (VH + G2.g1) or 3C3-IgG2-IgG1 | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE PQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPG |
| 245 | 3C3 (VH + G2.g1.1) or 3C3-IgG2-IgG1.1 | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PPVAGPSVFLFPPKPKDTLMISRTPEVTCVVVDVSHED PEVKFNWYVDGVEVHNAKTKPREEQYNSTYRVVSVLTV LHQDWLNGKEYKCKVSNKALPSSIEKTISKAKGQPREP QVYTLPPSREEMTKNQVSLTCLVKGFYPSDIAVEWESN GQPENNYKTTPPVLDSDGSFFLYSKLTVDKSRWQQGNV FSCSVMHEALHNHYTQKSLSLSPG |
| 246 | 3C3 (VH + G2(C219S).g1) or 3C3-IgG2-C219S-IgG1 | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE PQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPG |
| 247 | 3C3 (VH + G2(C219S).g1.1) or 3C3-IgG2-C219S-IgG1.1 | QVQLQQWGAGLLKPSETLSLTCAVYGGSFSGYYWTWIR QPPGKGLEWIGKINHSGNTNYNPSLKSRVTISVDTSKN QFSLKLSSVTAADTAVYYCARLGAFDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA PPVAGPSVFLFPPKPKDTLMISRTPEVTCVVVDVSHED PEVKFNWYVDGVEVHNAKTKPREEQYNSTYRVVSVLTV LHQDWLNGKEYKCKVSNKALPSSIEKTISKAKGQPREP QVYTLPPSREEMTKNQVSLTCLVKGFYPSDIAVEWESN GQPENNYKTTPPVLDSDGSFFLYSKLTVDKSRWQQGNV FSCSVMHEALHNHYTQKSLSLSPG |
| 248 | 2G6 (VH + G2) or 2G6-IgG2 | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVQFNWYVDGVEVHNAKTKPREEQFNSTFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPG |
| 249 | 2G6 (VH + G2(C219S)) or 2G6-IgG2-C219S | QVQLVESGGGVVQPGGSLRLSCAASGFILSDYGMHWVR QAPGKGLEWVTVIWYDGSNKFYVDSVKGRFTISRDNSK NTLYLQMNSLRVEDTAVYYCARGGRLATGHFYYVMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLFPPKPKDTLMISRTPEVTCVV |

TABLE 2-continued

SEQUENCES

| SEQ ID | Description | Sequence |
|---|---|---|
| | | VDVSHEDPEVQFNWYVDGVEVHNAKTKPREEQFNSTFR<br>VVSVLTVVHQDWLNGKEYKCKVSNKGLPAPIEKTISKI<br>KGQPREPQVYTLPPSREEMTKNQVSLTCLVKGFYPSDI<br>AVEWESNGQPENNYKTTPPMLDSDGSFFLYSKLTVDKS<br>RWQQGNVFSCSVMHEALHNHYTQKSLSLSPG |
| 250 | 2G6 (VH + G2.g1) or<br>2G6-IgG2-IgG1 | QVQLVESGGGVVQPGGSLRLSCAASGFILSDYGMHWVR<br>QAPGKGLEWVTVIWYDGSNKFYVDSVKGRFTISRDNSK<br>NTLYLQMNSLRVEDTAVYYCARGGRLATGHFYYVMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTVERKCCV<br>ECPPCPAPELLGGPSVFLFPPKPKDTLMISRTPEVTCV<br>VVDVSHEDPEVKFNWYVDGVEVHNAKTKPREEQYNSTY<br>RVVSVLTVLHQDWLNGKEYKCKVSNKALPAPIEKTISK<br>AKGQPREPQVYTLPPSREEMTKNQVSLTCLVKGFYPSD<br>IAVEWESNGQPENNYKTTPPVLDSDGSFFLYSKLTVDK<br>SRWQQGNVFSCSVMHEALHNHYTQKSLSLSPG |
| 251 | 2G6 (VH + G2.g1.1) or<br>2G6-IgG2-IgG1.1 | QVQLVESGGGVVQPGGSLRLSCAASGFILSDYGMHWVR<br>QAPGKGLEWVTVIWYDGSNKFYVDSVKGRFTISRDNSK<br>NTLYLQMNSLRVEDTAVYYCARGGRLATGHFYYVMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTVERKCCV<br>ECPPCPAPPVAGPSVFLFPPKPKDTLMISRTPEVTCVV<br>VDVSHEDPEVKFNWYVDGVEVHNAKTKPREEQYNSTYR<br>VVSVLTVLHQDWLNGKEYKCKVSNKALPSSIEKTISKA<br>KGQPREPQVYTLPPSREEMTKNQVSLTCLVKGFYPSDI<br>AVEWESNGQPENNYKTTPPVLDSDGSFFLYSKLTVDKS<br>RWQQGNVFSCSVMHEALHNHYTQKSLSLSPG |
| 252 | 2G6 (VH + G2(C219S).g1) or<br>2G6-IgG2-C219S-IgG1 | QVQLVESGGGVVQPGGSLRLSCAASGFILSDYGMHWVR<br>QAPGKGLEWVTVIWYDGSNKFYVDSVKGRFTISRDNSK<br>NTLYLQMNSLRVEDTAVYYCARGGRLATGHFYYVMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTVERKSCV<br>ECPPCPAPELLGGPSVFLFPPKPKDTLMISRTPEVTCV<br>VVDVSHEDPEVKFNWYVDGVEVHNAKTKPREEQYNSTY<br>RVVSVLTVLHQDWLNGKEYKCKVSNKALPAPIEKTISK<br>AKGQPREPQVYTLPPSREEMTKNQVSLTCLVKGFYPSD<br>IAVEWESNGQPENNYKTTPPVLDSDGSFFLYSKLTVDK<br>SRWQQGNVFSCSVMHEALHNHYTQKSLSLSPG |
| 253 | 2G6 (VH + G2(C219S).g1.1) or<br>2G6-IgG2-C219S-IgG1.1 | QVQLVESGGGVVQPGGSLRLSCAASGFILSDYGMHWVR<br>QAPGKGLEWVTVIWYDGSNKFYVDSVKGRFTISRDNSK<br>NTLYLQMNSLRVEDTAVYYCARGGRLATGHFYYVMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTVERKSCV<br>ECPPCPAPPVAGPSVFLFPPKPKDTLMISRTPEVTCVV<br>VDVSHEDPEVKFNWYVDGVEVHNAKTKPREEQYNSTYR<br>VVSVLTVLHQDWLNGKEYKCKVSNKALPSSIEKTISKA<br>KGQPREPQVYTLPPSREEMTKNQVSLTCLVKGFYPSDI<br>AVEWESNGQPENNYKTTPPVLDSDGSFFLYSKLTVDKS<br>RWQQGNVFSCSVMHEALHNHYTQKSLSLSPG |
| 86 | 8A6 (VH + G2) or<br>8A6-IgG2 | SEQ ID NO: 86 |
| 254 | 8A6 (VH + G2(C219S)) or<br>8A6-IgG2-C219S | QVQLVESGGGVVQPGRSLRLSCTASGFTSSYGMQWVR<br>QAPGKGLEWVAVIWYEGSNKYYADSVKGRFTISRENSK<br>NTLYLQMNSLRAEDTAVYYCARGGLMVRGLFYYGMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTVERKSCV<br>ECPPCPAPPVAGPSVFLFPPKPKDTLMISRTPEVTCVV<br>VDVSHEDPEVQFNWYVDGVEVHNAKTKPREEQFNSTFR<br>VVSVLTVVHQDWLNGKEYKCKVSNKGLPAPIEKTISKI<br>KGQPREPQVYTLPPSREEMTKNQVSLTCLVKGFYPSDI<br>AVEWESNGQPENNYKTTPPMLDSDGSFFLYSKLTVDKS<br>RWQQGNVFSCSVMHEALHNHYTQKSLSLSPG |

TABLE 2-continued

SEQUENCES

| SEQ ID | Description | Sequence |
|---|---|---|
| 255 | 8A6 (VH + G2.g1) or 8A6-IgG2-IgG1 | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 256 | 8A6 (VH + G2.g1.1) or 8A6-IgG2-IgG1.1 | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 257 | 8A6 (VH + G2(C219S).g1) or 8A6-IgG2-C219S-IgG1 | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 258 | 8A6 (VH + G2(C219S).g1.1) or 8A6-IgG2-C219S-IgG1.1 | QVQLVESGGGVVQPGRSLRLSCTASGFTFSSYGMQWVR QAPGKGLEWVAVIWYEGSNKYYADSVKGRFTISRENSK NTLYLQMNSLRAEDTAVYYCARGGLMVRGLFYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 259 | 9G7 (VH + G2) or 9G7-IgG2 | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKCC VECPPCPAPPVAGPSVFLFPPKPKDTLMISRTPEVTCV VVDVSHEDPEVQFNWYVDGVEVHNAKTKPREEQFNSTF RVVSVLTVVHQDWLNGKEYKCKVSNKGLPAPIEKTISK TKGQPREPQVYTLPPSREEMTKNQVSLTCLVKGFYPSD IAVEWESNGQPENNYKTTPPMLDSDGSFFLYSKLTVDK SRWQQGNVFSCSVMHEALHNHYTQKSLSLSPG |
| 260 | 9G7 (VH + G2(C219S)) or 9G7-IgG2-C219S | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKSC VECPPCPAPPVAGPSVFLFPPKPKDTLMISRTPEVTCV VVDVSHEDPEVQFNWYVDGVEVHNAKTKPREEQFNSTF RVVSVLTVVHQDWLNGKEYKCKVSNKGLPAPIEKTISK |

TABLE 2-continued

SEQUENCES

| SEQ ID | Description | Sequence |
|---|---|---|
| | | TKGQPREPQVYTLPPSREEMTKNQVSLTCLVKGFYPSD IAVEWESNGQPENNYKTTPPMLDSDGSFFLYSKLTVDK SRWQQGNVFSCSVMHEALHNHYTQKSLSLSPG |
| 261 | 9G7 (VH + G2.g1) or 9G7-IgG2-IgG1 | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKCC VECPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPG |
| 262 | 9G7 (VH + G2.g1.1) or 9G7-IgG2-IgG1.1 | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKCC VECPPCPAPPVAGPSVFLFPPKPKDTLMISRTPEVTCV VVVDVSHEDPEVKFNWYVDGVEVHNAKTKPREEQYNSTY RVVSVLTVLHQDWLNGKEYKCKVSNKALPSSIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 263 | 9G7 (VH + G2(C219S).g1) or 9G7-IgG2-C219S-IgG1 | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKSC VECPPCPAPELLGGPSVFLFPPKPKDTLMISRTPEVTC VVVDVSHEDPEVKFNWYVDGVEVHNAKTKPREEQYNST YRVVSVLTVLHQDWLNGKEYKCKVSNKALPAPIEKTIS KAKGQPREPQVYTLPPSREEMTKNQVSLTCLVKGFYPS DIAVEWESNGQPENNYKTTPPVLDSDGSFFLYSKLTVD KSRWQQGNVFSCSVMHEALHNHYTQKSLSLSPG |
| 264 | 9G7 (VH + G2(C219S).g1.1) or 9G7-IgG2-C219S-IgG1.1 | EVQLVESGGGLVKPGGSLRLSCAASGFTFSTVWMSWVR QAPGKGLEWVGRIKSKTDGGTTDYAAPVKGRFTISRDD SKNTLYLQMNSLHTEDTAVYYCTTGQLIPYSYYYGMDV WGQGTSVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKSC VECPPCPAPPVAGPSVFLFPPKPKDTLMISRTPEVTCV VVVDVSHEDPEVKFNWYVDGVEVHNAKTKPREEQYNSTY RVVSVLTVLHQDWLNGKEYKCKVSNKALPSSIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 265 | 14E3 (VH + G2) or 14E3-IgG2 | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PPVAGPSVFLFPPKPKDTLMISRTPEVTCVVVDVSHED PEVQFNWYVDGVEVHNAKTKPREEQFNSTFRVVSVLTV VHQDWLNGKEYKCKVSNKGLPAPIEKTISKTKGQPREP QVYTLPPSREEMTKNQVSLTCLVKGFYPSDIAVEWESN GQPENNYKTTPPMLDSDGSFFLYSKLTVDKSRWQQGNV FSCSVMHEALHNHYTQKSLSLSPG |
| 266 | 14E3 (VH + G2(C219S)) or 14E3-IgG2-C219S | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA |

TABLE 2-continued

SEQUENCES

| SEQ ID | Description | Sequence |
|---|---|---|
| | | PPVAGPSVFLFPPKPKDTLMISRTPEVTCVVVDVSHED PEVQFNWYVDGVEVHNAKTKPREEQFNSTFRVVSVLTV VHQDWLNGKEYKCKVSNKGLPAPIEKTISKTKGQPREP QVYTLPPSREEMTKNQVSLTCLVKGFYPSDIAVEWESN GQPENNYKTTPPMLDSDGSFFLYSKLTVDKSRWQQGNV FSCSVMHEALHNHYTQKSLSLSPG |
| 267 | 14E3 (VH + G2.g1) or 14E3-IgG2-IgG1 | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE PQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPG |
| 268 | 14E3 (VH + G2.g1.1) or 14E3-IgG2-IgG1.1 | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKCCVECPPCPA PPVAGPSVFLFPPKPKDTLMISRTPEVTCVVVDVSHED PEVKFNWYVDGVEVHNAKTKPREEQYNSTYRVVSVLTV LHQDWLNGKEYKCKVSNKALPSSIEKTISKAKGQPREP QVYTLPPSREEMTKNQVSLTCLVKGFYPSDIAVEWESN GQPENNYKTTPPVLDSDGSFFLYSKLTVDKSRWQQGNV FSCSVMHEALHNHYTQKSLSLSPG |
| 269 | 14E3 (VH + G2(C219S).g1) or 14E3-IgG2-C219S-IgG1 | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA PELLGGPSVFLFPPKPKDTLMISRTPEVTCVVVDVSHE DPEVKFNWYVDGVEVHNAKTKPREEQYNSTYRVVSVLT VLHQDWLNGKEYKCKVSNKALPAPIEKTISKAKGQPRE PQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPG |
| 270 | 14E3 (VH G2(C219S).g1.1) or 14E3-IgG2-C219S-IgG1.1 | QVQLQQWGAGLLKPSETLSLTCAVYGGSFSGYYWSWIR QPPGKGLEWIGEINHSGNTYYNPSLKSRVTISVDTSKN QLSLKLSSVTAADTAVYYCARFGSNDAFDIWGQGTMVT VSSASTKGPSVFPLAPCSRSTSESTAALGCLVKDYFPE PVTVSWNSGALTSGVHTFPAVLQSSGLYSLSSVVTVPS SNFGTQTYTCNVDHKPSNTKVDKTVERKSCVECPPCPA PPVAGPSVFLFPPKPKDTLMISRTPEVTCVVVDVSHED PEVKFNWYVDGVEVHNAKTKPREEQYNSTYRVVSVLTV LHQDWLNGKEYKCKVSNKALPSSIEKTISKAKGQPREP QVYTLPPSREEMTKNQVSLTCLVKGFYPSDIAVEWESN GQPENNYKTTPPVLDSDGSFFLYSKLTVDKSRWQQGNV FSCSVMHEALHNHYTQKSLSLSPG |
| 131 | 19H8 (VH + G2) or 19H8-IgG2 | SEQ ID NO: 131 |
| 271 | 19H8 (VH + G2(C219S)) or 19H8-IgG2-C219S | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLFPPKPKDTLMISRTPEVTCVV VDVSHEDPEVQFNWYVDGVEVHNAKTKPREEQFNSIFR VVSVLTVVHQDWLNGKEYKCKVSNKGLPAPIEKTISKI KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPG |

TABLE 2-continued

SEQUENCES

| SEQ ID | Description | Sequence |
|---|---|---|
| 272 | 19H8 (VH + G2.g1) or 19H8-IgG2-IgG1 | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 273 | 19H8 (VH + G2.g1.1) or 19H8-IgG2-IgG1.1 | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKCCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 274 | 19H8 (VH + G2(C219S).g1) or 19H8-IgG2-C219S-IgG1 | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 275 | 19H8 (VH G2(C219S).g1.1) or 19H8-IgG2-C219S-IgG1.1 | QVQLVESGGGVVQPGRSLRLSCAASGFTFSNYGMHWVR QAPGKGLEWMAVIWYGGSNKFYADSVKGRFTISRDNSK NSLSLQMNSLRAEDTAVYYCARGGAMVRGVYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKTVERKSCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 276 | Heavy chain C-terminus | LSPG |
| 277 | — | |
| 278 | Wildtype human IgG1 CH1 | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV |
| 279 | Wildtype human IgG2 CH1 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTV |
| 280 | Wildtype human IgG1 CH2 | PSVFLFPPKPKDTLMISRTPEVTCVVVDVSHEDPEVKF NWYVDGVEVHNAKTKPREEQYNSTYRVVSVLTVLHQDW LNGKEYKCKVSNKALPAPIEKTISKAK |
| 281 | Human IgG1 CH2 with A330S/P331S | PSVFLFPPKPKDTLMISRTPEVTCVVVDVSHEDPEVKF NWYVDGVEVHNAKTKPREEQYNSTYRVVSVLTVLHQDW LNGKEYKCKVSNKALPSSIEKTISKAK |
| 282 | Wildtype human IgG1 CH3 | GQPREPQVYTLPPSREEMTKNQVSLTCLVKGFYPSDIA VEWESNGQPENNYKTTPPVLDSDGSFFLYSKLTVDKSR WQQGNVFSCSVMHEALHNHYTQKSLSLSPG |

TABLE 2-continued

SEQUENCES

| SEQ ID | Description | Sequence |
|---|---|---|
| 283 | IgG1-IgG2-IgG1f | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKCCVECPPCPAPEL LGG</u>PSVFLFPPKPKDTLMISRTPEVTCVVVDVSHEDPE VKFNWYVDGVEVHNAKTKPREEQYNSTYRVVSVLTVLH QDWLNGKEYKCKVSNKALPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPG |
| 284 | IgG1-IgG2CS-IgG1f | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKSCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALPAPIEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 285 | IgG1-IgG2-IgG1.1f | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKCCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALPSSIEKTISKAKGQPREPQVY TLPPSRREMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 286 | IgG1-IgG2CS-IgG1.1f | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKSCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALP<u>SS</u>IEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 287 | IgG1-IgG2-1gG1f2 | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKCCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALPAPIEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 288 | IgG1-IgG2(C219S)-IgG1f2 | ASTKGPSVFPLAPSSKSTSGGTAALGCLVKDYFPEPVT VSWNSGALTSGVHTFPAVLQSSGLYSLSSVVTVPSSSL GTQTYICNVNHKPSNTKVDKKV<u>ERKSCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALPAPIEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 289 | IgG2-IgG1f2 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTV<u>ERKCCVECPPCPAPPV AG</u>PSVFLFPPKPKDTLMISRTPEVTCVVVDVSHEDPEV KFNWYVDGVEVHNAKTKPREEQYNSTYRVVSVLTVLHQ DWLNGKEYKCKVSNKALPAPIEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 290 | IgG2(C219S)-IgG1f2 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTV<u>ERKSCVECPPCPAPPV AG</u>PSVFLFPPKPKDTLMISRTPEVTCVVVDVSHEDPEV |

TABLE 2-continued

SEQUENCES

| SEQ ID | Description | Sequence |
|---|---|---|
| | | KFNWYVDGVEVHNAKTKPREEQYNSTYRVVSVLTVLHQ DWLNGKEYKCKVSNKALPAPIEKTISKAKGQPREPQVY TLPPSREEMTKNQVSLTCLVKGFYPSDIAVEWESNGQP ENNYKTTPPVLDSDGSFFLYSKLTVDKSRWQQGNVFSC SVMHEALHNHYTQKSLSLSPG |
| 291 | WT human IgG2 hinge | ERKCCVECPPCPAPPVAG |
| 292 | Human IgG2 hinge with C219S | ERKSCVECPPCPAPPVAG |
| 293 | IgG2/IgG1 hinge | ERKCCVECPPCPAPELLGG |
| 294 | IgG2 (C219S)/IgG1 hinge | ERKSCVECPPCPAPELLGG |
| 295 | Wild type human IgG1 hinge | EPKSCDKTHTCPPCPAPELLGG |
| 296 | IgG1.1 Hinge (L234A/L235E/G237A) | EPKSCDKTHTCPPCPAPEAEGA |
| 297 | Wildtype human IgG2 CH2 | PSVFLFPPKPKDTLMISRTPEVTCVVVDVSHEDPEVQF NWYVDGVEVHNAKTKPREEQFNSTFRVVSVLTVVHQDW LNGKEYKCKVSNKGLPAPIEKTISKTK |
| 298 | Wildtype human IgG2 CH3 | GQPREPQVYTLPPSREEMTKNQVSLTCLVKGFYPSDIA VEWESNGQPENNYKTTPPMLDSDGSFFLYSKLTVDKSR WQQGNVFSCSVMHEALHNHYTQKSLSLSPGK |
| 299 | IgG1 C-terminal $C_H1$ (same for IgG3 (17-15-15-15), igG3 (17-15-15), IgG3 (17-15), IgG3 (15-15-15), IgG3 (15), and IgG4 | VDKRV |
| 300 | IgG2 C-terminal $C_H1$ | VDKTV |
| 301 | IgG1 upper hinge | EPKSCDKTHT |
| 302 | IgG3 (17-15-15-15) upper hinge (same for IgG3 (17-15-15) and IgG3 (17-15)) | ELKTPLGDTTHT |
| 303 | IgG3 (15-15-15) upper hinge (same for IgG3(15)) | EPKS |
| 304 | IgG4 upper hinge | ESKYGPP |
| 305 | IgG1 middle hinge | CPPCP |
| 306 | IgG2 middle hinge | CCVECPPCP |
| 307 | IgG3 (17-15-15-15) middle hinge | CPRCP(EPKSCDTPPPCPRCP)$_3$ |
| 308 | IgG3 (17-15-15) middle hinge | CPRCP(EPKSCDTPPPCPRCP)$_2$ |
| 309 | IgG3 (17-15) middle hinge | CPRCPEPKSCDTPPPCPRCP |
| 310 | IgG3 (15-15-15) middle hinge | CDTPPPCPRCP(EPKSCDTPPPCPRCP)$_2$ |
| 311 | IgG3 (15) middle hinge | CDTPPPCPRCP |
| 312 | IgG4 middle hinge | CPSCP |
| 313 | IgG1 lower hinge (same for IgG3 (17-15-15-15), IgG3 (17-15-15), IgG3 (17-15), IgG3 (15-15-15), IgG3 (15), and IgG4) | APELLGG |

TABLE 2-continued

SEQUENCES

| SEQ ID | Description | Sequence |
|---|---|---|
| 314 | IgG2 lower hinge | APPVAG |
| 315 | 28F3 VH signal sequence (same for 18E10, 19D3, 19H8, 6G10) | MEFGLSWVFLVALLRGVQC |
| 316 | 28F3 VH signal sequence (nucleotide sequence) | ATGGAGTTTGGGCTGAGCTGGGTTTTCCTCGTTGCTCTTTTAAGAGGTGTCCAGTGT |
| 317 | 28F3 VL signal sequence (same for 18E10, 8A6, 19H8VL1, 6G10) | MDMRVPAQLLGLLLLWLPGARC |
| 318 | 28F3 VL signal sequence (nucleotide sequence) | ATGGACATGAGGGTCCCCGCTCAGCTCCTGGGGCTTCTGCTGCTCTGGCTCCCAGGTGCCAGAT |
| 319 | 19D3 VL signal sequence | MRVLAQLLGLLLLCFPGARC |
| 320 | 19D3 VL signal sequence (nucleotide sequence) | ATGAGGGTCCTCGCTCAGCTCCTGGGGCTCCTGCTGCTCTGTTTCCCAGGTGCCAGATGT |
| 321 | 3C3 VH signal sequence (same for 14E3) | MKHLWFFLLLVAAPRWVLS |
| 322 | 3C3 VH signal sequence (nucleotide sequence) | ATGAAACACCTGTGGTTCTTCCTCCTCCTGGTGGCAGCTCCCAGATGGGTCCTGTCC |
| 323 | 3C3 VL signal sequence (same for 14E3) | MDMRVLAQLLGLLLLCFPGARC |
| 324 | 3C3 VL signal sequence (nucleotide sequence) | ATGGACATGAGGGTCCTCGCTCAGCTCCTGGGGCTCCTGCTGCTCTGTTTCCCAGGTGCCAGATGT |
| 325 | 3C3 VL2 signal sequence (same for 19H8 VL2) | MEAPAQLLFLLLLWLPDTTG |
| 326 | 3C3 VL2 signal sequence (nucleotide sequence) | ATGGAAGCCCCAGCGCAGCTTCTCTTCCTCCTGCTACTCTGGCTCCCAGATACCACCGGA |
| 327 | 8A6 VH signal sequence | MEFGLNWVFLVALLRGVQC |
| 328 | 8A6 VH signal sequence (nucleotide sequence) | ATGGAGTTTGGGCTGAACTGGGTTTTCCTCGTTGCTCTTTTAAGAGGTGTCCAGTGT |
| 329 | 9G7 VH signal sequence | MEFGLSWIFLAAILKGVQC |
| 330 | 9G7 VH signal sequence (nucleotide sequence) | ATGGAGTTTGGGCTGAGCTGGATTTTCCTTGCTGCTATTTTAAAAGGTGTCCAGTGT |
| 331 | 9G7 VL1 and VL2 signal sequence | METPAQLLFLLLLWLPDTTG |
| 332 | 9G7 VL1 and VL2 signal sequence (nucleotide sequence) | ATGGAAACCCCAGCGCAGCTTCTCTTCCTCCTGCTACTCTGGCTCCCAGATACCACCGGA |
| 333 | 14E3 VH signal sequence | MKHLWFFLLLVAAPRWVLS |
| 334 | 14E3 VH signal sequence (nucleotide sequence) | ATGAAACACCTGTGGTTCTTCCTCCTCCTGGTGGCAGCTCCCAGATGGGTCCTGTCC |
| 335 | 6G10 (VH) | QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSS |
| 336 | 6G10 (VL) | AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK |
| 337 | 6G10 (full length wild-type heavy chain) The constant region is underlined | QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSS<u>ASTKGPSVFPLAPCSRSTSESTAALGCL</u> |

TABLE 2-continued

SEQUENCES

| SEQ ID | Description | Sequence |
|---|---|---|
| | | VKDYFPEPVTVSWNSGALTSGVHTFPAVLQSSGLYSLS<br>SVVTVPSSNFGTQTYTCNVDHKPSNTKVDKTVERKCCV<br>ECPPCPAPPVAGPSVFLFPPKPKDTLMISRTPEVTCVV<br>VDVSHEDPEVQFNWYVDGVEVHNAKTKPREEQFNSTFR<br>VVSVLTVVHQDWLNGKEYKCKVSNKGLPAPIEKTISKT<br>KGQPREPQVYTLPPSREEMTKNQVSLTCLVKGFYPSDI<br>AVEWESNGQPENNYKTTPPMLDSDGSFFLYSKLTVDKS<br>RWQQGNVFSCSVMHEALHNHYTQKSLSLSPGK |
| 338 | 6G10 (full length wild-type light chain) The constant region is underlined | AIQLTQSPSSLSASVGDRVTITCRASQGISSALAWYQQ<br>KPGKAPKLLIYDASSLESGVPSRFSGSGSGTDFTLTIS<br>SLQPEDFATYYCQQFNSYPYTFGQGTKLEIK<u>RTVAAPS</u><br><u>VFIFPPSDEQLKSGTASVVCLLNNFYPREAKVQWKVDN</u><br><u>ALQSGNSQESVTEQDSKDSTYSLSSTLTLSKADYEKHK</u><br><u>VYACEVTHQGLSSPVTKSFNRGEC</u> |
| 339 | 6G10.IgG1 (VH + IgG1) | QVQLVESGGDVVQPGRSLRLSCAASGFTFSTYGMHWVR<br>QAPGKGLEWVAVTWYAGSNKFYADSVKGRFTISRDNSK<br>NTLYLQMNSLRAEDTAVYYCARGGSMVRGLYYYGMDVW<br>GQGTTVTVSSASTKGPSVFPLAPSSKSTSGGTAALGCL<br>VKDYFPEPVTVSWNSGALTSGVHTFPAVLQSSGLYSLS<br>SVVTVPSSSLGTQTYICNVNHKPSNTKVDKRVEPKSCD<br>KTHTCPPCPAPELLGGPSVFLFPPKPKDTLMISRTPEV<br>TCVVVDVSHEDPEVKFNWYVDGVEVHNAKTKPREEQYN<br>STYRVVSVLTVLHQDWLNGKEYKCKVSNKALPAPIEKT<br>ISKAKGQPREPQVYTLPPSREEMTKNQVSLTCLVKGFY<br>PSDIAVEWESNGQPENNYKTTPPVLDSDGSFFLYSKLT<br>VDKSRWQQGNVFSCSVMHEALHNHYTQKSLSLSPG |
| 340 | 6G10.IgG1.1 (VH + IgG1.1) | QVQLVESGGDVVQPGRSLRLSCAASGFTFSTYGMHWVR<br>QAPGKGLEWVAVTWYAGSNKFYADSVKGRFTISRDNSK<br>NTLYLQMNSLRAEDTAVYYCARGGSMVRGLYYYGMDVW<br>GQGTTVTVSSASTKGPSVFPLAPSSKSTSGGTAALGCL<br>VKDYFPEPVTVSWNSGALTSGVHTFPAVLQSSGLYSLS<br>SVVTVPSSSLGTQTYICNVNHKPSNTKVDKRVEPKSCD<br>KTHTCPPCPAPE<u>AEGA</u>PSVFLFPPKPKDTLMISRTPEV<br>TCVVVDVSHEDPEVKFNWYVDGVEVHNAKTKPREEQYN<br>STYRVVSVLTVLHQDWLNGKEYKCKVSNKALP<u>SS</u>IEKT<br>ISKAKGQPREPQVYTLPPSREEMTKNQV<u>S</u>LTCLVKGFY<br>PSDIAVEWESNGQPENNYKTTPPVLDSDGSFFLYSKLT<br>VDKSRWQQGNVFSCSVMHEALHNHYTQKSLSLSPG |
| 341 | 6G10.IgG1 (VL + CL) | AIQLTQSPSSLSASVGDRVTITCRASQGISSALAWYQQ<br>KPGKAPKLLIYDASSLESGVPSRFSGSGSGTDFTLTIS<br>SLQPEDFATYYCQQFNSYPYTFGQGTKLEIKRTVAAPS<br>VFIFPPSDEQLKSGTASVVCLLNNFYPREAKVQWKVDN<br>ALQSGNSQESVTEQDSKDSTYSLSSTLTLSKADYEKHK<br>VYACEVTHQGLSSPVTKSFNRGEC |
| 342 | 6G10 VH CDR1 | TYGMH |
| 343 | 6G10 VH CDR2 | VTWYAGSNKFYADSVKG |
| 344 | 6G10 VH CDR3 | GGSMVRGLYYYGMDV |
| 345 | 6G10 VL CDR1 | RASQGISSALA |
| 346 | 6G10 VL CDR2 | DASSLES |
| 347 | 6G10 VL CDR3 | QQFNSYPYT |
| 337 | 6G10 (VH + G2) or 6G10-IgG2 | SEQ ID NO: 337 |
| 348 | 6G10 (VH + G2(C219S)) or 6G10-IgG2-C219S | QVQLVESGGDVVQPGRSLRLSCAASGFTFSTYGMHWVR<br>QAPGKGLEWVAVTWYAGSNKFYADSVKGRFTISRDNSK<br>NTLYLQMNSLRAEDTAVYYCARGGSMVRGLYYYGMDVW<br>GQGTTVTVSSASTKGPSVFPLAPCSRSTSESTAALGCL<br>VKDYFPEPVTVSWNSGALTSGVHTFPAVLQSSGLYSLS<br>SVVTVPSSNFGTQTYTCNVDHKPSNTKVDKTV<u>ERKSCV</u><br><u>ECPPCPAPPVA</u>GPSVFLFPPKPKDTLMISRTPEVTCVV<br>VDVSHEDPEVQFNWYVDGVEVHNAKTKPREEQFNSTFR<br>VVSVLTVVHQDWLNGKEYKCKVSNKGLPAPIEKTISKT |

TABLE 2-continued

SEQUENCES

| SEQ ID | Description | Sequence |
|---|---|---|
| | | KGQPREPQVYTLPPSREEMTKNQVSLTCLVKGFYPSDI AVEWESNGQPENNYKTTPPMLDSDGSFFLYSKLTVDKS RWQQGNVFSCSVMHEALHNHYTQKSLSLSPG |
| 349 | 6G10 (VH + G2.g1) or 6G10-IgG2-IgG1 | QVQLVESGGDVVQPGRSLRLSCAASGFTFSTYGMHWVR QAPGKGLEWVAVTWYAGSNKFYADSVKGRFTISRDNSK NTLYLQMNSLRAEDTAVYYCARGGSMVRGLYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKVERKCCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 350 | 6G10 (VH + G2.g1.1) or 6G10-IgG2-IgG1.1 | QVQLVESGGDVVQPGRSLRLSCAASGFTFSTYGMHWVR QAPGKGLEWVAVTWYAGSNKFYADSVKGRFTISRDNSK NTLYLQMNSLRAEDTAVYYCARGGSMVRGLYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKVERKCCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 351 | 6G10 (VH + G2(C219S).g1) or 6G10-IgG2-C219S-IgG1 | QVQLVESGGDVVQPGRSLRLSCAASGFTFSTYGMHWVR QAPGKGLEWVAVTWYAGSNKFYADSVKGRFTISRDNSK NTLYLQMNSLRAEDTAVYYCARGGSMVRGLYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKVERKSCV ECPPCPAPELLGGPSVFLFPPKPKDTLMISRTPEVTCV VVDVSHEDPEVKFNWYVDGVEVHNAKTKPREEQYNSTY RVVSVLTVLHQDWLNGKEYKCKVSNKALPAPIEKTISK AKGQPREPQVYTLPPSREEMTKNQVSLTCLVKGFYPSD IAVEWESNGQPENNYKTTPPVLDSDGSFFLYSKLTVDK SRWQQGNVFSCSVMHEALHNHYTQKSLSLSPG |
| 352 | 6G10 (VH G2(C219S).g1.1) or 6G10-IgG2-C219S-IgG1.1 | QVQLVESGGDVVQPGRSLRLSCAASGFTFSTYGMHWVR QAPGKGLEWVAVTWYAGSNKFYADSVKGRFTISRDNSK NTLYLQMNSLRAEDTAVYYCARGGSMVRGLYYYGMDVW GQGTTVTVSSASTKGPSVFPLAPCSRSTSESTAALGCL VKDYFPEPVTVSWNSGALTSGVHTFPAVLQSSGLYSLS SVVTVPSSNFGTQTYTCNVDHKPSNTKVDKVERKSCV ECPPCPAPPVAGPSVFLFPPKPKDTLMISRTPEVTCVV VDVSHEDPEVKFNWYVDGVEVHNAKTKPREEQYNSTYR VVSVLTVLHQDWLNGKEYKCKVSNKALPSSIEKTISKA KGQPREPQVYTLPPSREEMTKNQVSLTCLVKGFYPSDI AVEWESNGQPENNYKTTPPVLDSDGSFFLYSKLTVDKS RWQQGNVFSCSVMHEALHNHYTQKSLSLSPG |
| 353 | 6G10 (VH) nucleotide sequence | CAGGTGCAGCTGGTGGAGTCTGGGGGAGACGTGGTCCA GCCTGGGAGGTCCCTGAGACTCTCCTGTGCAGCGTCTG GATTCACCTTCAGTACCTATGGCATGCACTGGGTCCGC CAGGCTCCAGGCAAGGGGCTGGAGTGGGTGGCAGTTAC ATGGTATGCTGGAAGTAATAAATTTTATGCAGACTCCG TGAAGGGCCGATTCACCATCTCCAGAGACAATTCCAAG AACACGCTGTATCTGCAAATGAACAGCCTGAGAGCCGA GGACACGGCTGTGTATTACTGTGCGAGAGGAGGTAGTA TGGTTCGGGGACTTTATTATTACGGTATGGACGTCTGG GGCCAAGGGACCACGGTCACCGTCTCCTCA |
| 354 | 6G10 (VL) nucleotide sequence | GCCATCCAGTTGACCCAGTCTCCATCCTCCCTGTCTGC ATCTGTAGGAGACAGAGTCACCATCACTTGCCGGGCAA GTCAGGGCATTAGCAGTGCTTTAGCCTGGTATCAGCAG AAACCAGGGAAAGCTCCTAAGCTCCTGATCTATGATGC CTCCAGTTTGGAAAGTGGGGTCCCATCAAGGTTCAGCG GCAGTGGATCTGGGACAGATTTCACTCTCACCATCAGC |

TABLE 2-continued

SEQUENCES

| SEQ ID | Description | Sequence |
|---|---|---|
| | | AGCCTGCAGCCTGAAGATTTTGCAACTTATTACTGTCA ACAGTTTAATAGTTACCCGTACACTTTTGGCCAGGGGA CCAAGCTGGAGATCAAA |
| 355 | 6G10 (full length wild-type heavy chain) nucleotide sequence The sequence encoding the constant region is underlined | CAGGTGCAGCTGGTGGAGTCTGGGGGAGACGTGGTCCA GCCTGGGAGGTCCCTGAGACTCTCCTGTGCAGCGTCTG GATTCACCTTCAGTACCTATGGCATGCACTGGGTCCGC CAGGCTCCAGGCAAGGGGCTGGAGTGGGTGGCAGTTAC ATGGTATGCTGGAAGTAATAAATTTTATGCAGACTCCG TGAAGGGCCGATTCACCATCTCCAGAGACAATTCCAAG AACACGCTGTATCTGCAAATGAACAGCCTGAGAGCCGA GGACACGGCTGTGTATTACTGTGCGAGAGGAGGTAGTA TGGTTCGGGGACTTTATTATTACGGTATGGACGTCTGG GGCCAAGGGACCACGGTCACCGTCTCCTCAGCCTCCAC CAAGGGCCCATCGGTCTTCCCCCTGGCGCCCTGCTCCA GGAGCACCTCCGAGAGCACAGCGGCCCTGGGCTGCCTG GTCAAGGACTACTTCCCCGAACCGGTGACGGTGTCGTG GAACTCAGGCGCTCTGACCAGCGGCGTGCACACCTTCC CAGCTGTCCTACAGTCCTCAGGACTCTACTCCCTCAGC AGCGTGGTGACCGTGCCCTCCAGCAACTTCGGCACCCA GACCTACACCTGCAACGTAGATCACAAGCCCAGCAACA CCAAGGTGGACAAGACAGTTGAGCGCAAATGTTGTGTC GAGTGCCCACCGTGCCCAGCACCACCTGTGGCAGGACC GTCAGTCTTCCTCTTCCCCCCAAAACCCAAGGACACCC TCATGATCTCCCGGACCCCTGAGGTCACGTGCGTGGTG GTGGACGTGAGCCACGAAGACCCCGAGGTCCAGTTCAA CTGGTACGTGGACGGCGTGGAGGTGCATAATGCCAAGA CAAAGCCACGGGAGGAGCAGTTCAACAGCACGTTCCGT GTGGTCAGCGTCCTCACCGTTGTGCACCAGGACTGGCT GAACGGCAAGGAGTACAAGTGCAAGGTCTCCAACAAAG GCCTCCCAGCCCCCATCGAGAAAACCATCTCCAAAACC AAAGGGCAGCCCCGAGAACCACAGGTGTACACCCTGCC CCCATCCCGGGAGGAGATGACCAAGAACCAGGTCAGCC TGACCTGCCTGGTCAAAGGCTTCTACCCCAGCGACATC GCCGTGGAGTGGGAGAGCAATGGGCAGCCGGAGAACAA CTACAAGACCACACCTCCCATGCTGGACTCCGACGGCT CCTTCTTCCTCTACAGCAAGCTCACCGTGGACAAGAGC AGGTGGCAGCAGGGGAACGTCTTCTCATGCTCCGTGAT GCATGAGGCTCTGCACAACCACTACACGCAGAAGAGCC TCTCCCTGTCTCCGGGTAAA |
| 356 | 6G10 (full length wild-type light chain) nucleotide sequence The sequence enconding the constant region is underlined | GCCATCCAGTTGACCCAGTCTCCATCCTCCCTGTCTGC ATCTGTAGGAGACAGAGTCACCATCACTTGCCGGGCAA GTCAGGGCATTAGCAGTGCTTTAGCCTGGTATCAGCAG AAACCAGGGAAAGCTCCTAAGCTCCTGATCTATGATGC CTCCAGTTTGGAAAGTGGGGTCCCATCAAGGTTCAGCG GCAGTGGATCTGGGACAGATTTCACTCTCACCATCAGC AGCCTGCAGCCTGAAGATTTTGCAACTTATTACTGTCA ACAGTTTAATAGTTACCCGTACACTTTTGGCCAGGGGA CCAAGCTGGAGATCAAAC<u>GAACTGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAAC GCCCTCCAATCGGGTAACTCCCAGGAGAGTGTCACAGA GCAGGACAGCAAGGACAGCACCTACAGCCTCAGCAGCA CCCTGACGCTGAGCAAAGCAGACTACGAGAAACACAAA GTCTACGCCTGCGAAGTCACCCATCAGGGCCTGAGCTC GCCCGTCACAAAGAGCTTCAACAGGGGAGAGTGT</u> |
| 357 | 28F3 (VH) (SEQ ID NO: 13) with signal peptide The signal peptide is underlined | <u>MRAWIFFLLCLAGRALA</u>QVQLVESGGGVVQPGRSLRLS CAASGFTFSSYGMHWVRQAPGKGLEWVAVIWYEGSNKY YADSVKGRFTISRDNSKNTLYLQMNSLRAEDTAVYYCA RGGSMVRGDYYYGMDVWGQGTTVTSS |
| 358 | 28F3 (VL) (SEQ ID NO: 14) with signal peptide The signal peptide is underlined | <u>MRAWIFFLLCLAGRALA</u>AIQLTQSPSSLSASVGDRVTI TCRASQGISSALAWYQQKPGKAPKLLIYDASSLESGVP SRFSGSGSGTDFTLTISSLQPEDFATYYCQQFNSYPYT FGQGTKLEIK |
| 359 | 28F3 (VH) with signal peptide nucleotide sequence SEQ ID NO: 147 with sequence encoding signal peptide | <u>atgagggcttggatcttctttctgctctgcctggccgg gagagcgctcgca</u>CAGGTGCAGCTGGTGGAGTCTGGGG GAGGCGTGGTCCAGCCTGGGAGGTCCCTGAGACTCTCC TGTGCAGCGTCTGGATTCACCTTCAGTAGCTATGGCAT GCACTGGGTCCGCCAGGCTCCAGGCAAGGGGCTGGAGT |

TABLE 2-continued

SEQUENCES

| SEQ ID | Description | Sequence |
|---|---|---|
| | The sequence encoding the signal peptide is underlined | GGGTGGCAGTTATATGGTATGAAGGAAGTAATAAATAT TATGCAGACTCCGTGAAGGGCCGATTCACCATCTCCAG AGACAATTCCAAGAACACGCTGTATCTGCAAATGAACA GCCTGAGAGCCGAGGACACGGCTGTGTATTACTGTGCG AGAGGGGGGAGTATGGTTCGGGGGACTACTACTACGG TATGGACGTCTGGGGCCAAGGGACCACGGTCACCGTCT CCTCA |
| 360 | 28F3 (VL) with signal peptide nucleotide sequence SEQ ID NO: 148 with sequence encoding signal peptide The sequence encoding the signal peptide is underlined | <u>atgagggcttggatcttctttctgctctgcctggccgg gcgcgccttggcc</u>GCCATCCAGTTGACCCAGTCTCCAT CCTCCCTGTCTGCATCTGTAGGAGACAGAGTCACCATC ACTTGCCGGGCAAGTCAGGGCATTAGCAGTGCTTTAGC CTGGTATCAGCAGAAACCAGGGAAAGCTCCTAAGCTCC TGATCTATGATGCCTCCAGTTTGGAAAGTGGGGTCCCA TCAAGGTTCAGCGGCAGTGGATCTGGGACAGATTTCAC TCTCACCATCAGCAGCCTGCAGCCTGAAGATTTTGCAA CTTATTACTGTCAACAGTTTAATAGTTACCCGTACACT TTTGGCCAGGGGACCAAGCTGGAGATCAAA |
| 361 | 28F3.IgG1 (VH + IgG1) (SEQ ID NO: 17) with signal peptide The signal peptide and constant region are underlined | <u>MRAWIFFLLCLAGRALA</u>QVQLVESGGGVVQPGRSLRLS CAASGFTFSSYGMHWVRQAPGKGLEWVAVIWYEGSNKY YADSVKGRFTISRDNSKNTLYLQMNSLRAEDTAVYYCA RGGSMVRGDYYYGMDVWGQGTTVTVSS<u>ASTKGPSVFPL APSSKSTSGGTAALGCLVKDYFPEPVTVSWNSGALTSG VHTFPAVLQSSGLYSLSSVVTVPSSSLGTQTYICNVNH KPSNTKVDKRVEPKSCDKTHTCPPCPAPELLGGPSVFL FPPKPKDTLMISRTPEVTCVVVDVSHEDPEVKFNWYVD GVEVHNAKTKPREEQYNSTYRVVSVLTVLHQDWLNGKE YKCKVSNKALPAPIEKTISKAKGQPREPQVYTLPPSRE EMTKNQVSLTCLVKGFYPSDIAVEWESNGQPENNYKTT PPVLDSDGSFFLYSKLTVDKSRWQQGNVFSCSVMHEAL HNHYTQKSLSLSPG</u> |
| 362 | 28F3.IgG1.1 (VH + IgG1.1) (SEQ ID NO: 18) with signal peptide The signal peptide and constant region are underlined | <u>MRAWIFFLLCLAGRALA</u>QVQLVESGGGVVQPGRSLRLS CAASGFTFSSYGMHWVRQAPGKGLEWVAVIWYEGSNKY YADSVKGRFTISRDNSKNTLYLQMNSLRAEDTAVYYCA RGGSMVRGDYYYGMDVWGQGTTVTVSS<u>ASTKGPSVFPL APSSKSTSGGTAALGCLVKDYFPEPVTVSWNSGALTSG VHTFPAVLQSSGLYSLSSVVTVPSSSLGTQTYICNVNH KPSNTKVDKRVEPKSCDKTHTCPPCPAPEAEGAPSVFL FPPKPKDTLMISRTPEVTCVVVDVSHEDPEVKFNWYVD GVEVHNAKTKPREEQYNSTYRVVSVLTVLHQDWLNGKE YKCKVSNKALPSSIEKTISKAKGQPREPQVYTLPPSRE EMTKNQVSLTCLVKGFYPSDIAVEWESNGQPENNYKTT PPVLDSDGSFFLYSKLTVDKSRWQQGNVFSCSVMHEAL HNHYTQKSLSLSPG</u> |
| 363 | 28F3.IgG1 (VH + IgG1) with signal peptide nucleotide sequence SEQ ID NO: 151 with sequence encoding signal peptide The sequence encoding the signal peptide is underlined | <u>atgagggcttggatcttctttctgctctgcctggccgggagagc gctcgca</u>caggtgcagctggtggagtctgggggaggcgtggtcca gcctgggaggtccctgagactctcctgtgcagcgtctggattcacc ttcagtagctatggcatgcactgggtccgccaggctccaggcaagg ggctggagtgggtggcagttatatggtatgaaggaagtaataaata ttatgcagactccgtgaagggccgattcaccatctccagagacaat tccaagaacacgctgtatctgcaaatgaacagcctgagagccgagg acacggctgtgtattactgtgcgagagggggagtatggttcgggg ggactactactacggtatggacgtctggggccaagggaccacggtc accgtctcctcagctagcaccaagggcccatcggtcttccccctgg cacctcctccaagagcacctctgggggcacagcggccctgggctg cctggtcaaggactacttccccgaaccggtgacggtgtcgtggaac tcaggcgccctgaccagcggcgtgcacaccttcccggctgtcctac agtcctcaggactctactccctcagcagcgtggtgaccgtgccctc cagcagcttgggcacccagacctacatctgcaacgtgaatcacaag cccagcaacaccaaggtggacaagagagttgagcccaaatcttgtg acaaaactcacacatgcccaccgtgcccagcacctgaactcctggg gggaccgtcagtcttcctcttccccccaaaacccaaggacaccctc atgatctcccggacccctgaggtcacatgcgtggtggtggacgtga gccacgaagaccctgaggtcaagttcaactggtacgtggacggcgt ggaggtgcataatgccaagacaaagccgcgggaggagcagtacaac agcacgtaccgtgtggtcagcgtcctcaccgtcctgcaccaggact ggctgaatggcaaggagtacaagtgcaaggtctccaacaaagcct cccagcccccatcgagaaaaccatctccaaagccaaagggcagccc cgagaaccacaggtgtacaccctgcccccatcccgggaggagatga ccaagaaccaggtcagcctgacctgcctggtcaaaggcttctatcc cagcgacatcgccgtggagtgggagagcaatgggcagccggagaac aactacaagaccacgcctcccgtgctggactccgacggctccttct |

TABLE 2-continued

SEQUENCES

| SEQ ID | Description | Sequence |
|---|---|---|
| | | tcctctatagcaagctcaccgtggacaagagcaggtggcagcaggg gaacgtcttctcatgctccgtgatgcatgaggctctgcacaaccac tacacgcagaagagcctctccctgtccccgggttga |
| 364 | 28F3.IgG1.1 (VH + IgG1.1) with signal peptide nucleotide sequence SEQ ID NO: 152 with sequence encoding signal peptide The sequence encoding the signal peptide is underlined | <u>atgagggcttggatcttctttctgctctgcctggccgggagagc gctcgca</u>caggtgcagc tggtggagtc tgggggaggc<br>gtggtccagc ctggaggtc cctgagactc tcctgtgcag<br>cgtctggatt caccttcagt agctatggca tgcactgggt<br>ccgccaggct<br>ccaggcaagg ggctggagtg ggtggcagtt atatggtatg<br>aaggaagtaa taaatattat gcagactccg tgaagggccg<br>attccaccatc tccagagaca attccaagaa cacgctgtat<br>ctgcaaatga acagcctgag agccgaggac acggctgtgt<br>attactgtgc gagaggggg agtatggttc gggggggacta<br>ctactacggt atggacgtct ggggccaagg gaccacggtc<br>accgtctcct cagctagcac caagggccca tcggtcttcc<br>ccctggcacc ctcctccaag agcacctctg gggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc cagcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>gccgaagggg ccccgtcagt cttcctcttc cccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg<br>ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccaag cagcatcgag aaaaccatct ccaaagccaa<br>agggcagccc cgagaaccac aggtgtacac cctgccccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg tccccgggtt ga |
| 365 | 28F3.1gG1 (VL + CL) (SEQ ID NO: 19) with signal peptide The signal peptide and constant region are underlined | <u>MRAWIFFLLCLAGRALA</u>AIQLTQSPSSLSASVGDRVTITCRASQ GISSALAWYQQKPGKAPKLLIYDASSLESGVPSRFSGSGSGTDF TLTISSLQPEDFATYYCQQFNSYPYTFGQGTKLEIK<u>RTVAAPSV FIFPPSDEQLKSGTASVVCLLNNFYPREAKVQWKVDNALQSGNS QESVTEQDSKDSTYSLSSTLTLSKADYEKHKVYACEVTHQGLSS PVTKSFNRGEC</u> |
| 366 | 28F3.1gG1 (VL + CL) with signal peptide nucleotide sequence SEQ ID NO: 153 with signal sequence The sequence encoding the signal peptide is underlined | <u>atgagggcttggatcttctttctgctctgcctggccgggcgcgc cttggccgcc</u>atccagttgacccagtctccatcctcctgtgtgc atctgtaggagacagagtcaccatcacttgccgggcaagtcaggc attagcagtgctttagcctggtatcagcagaaaccagggaaagctc ctaagctcctgatctatgatgcctccagtttggaaagtggggtccc atcaaggttcagcggcagtggatctgggacagatttcactctcacc atcagcagcctgcagcctgaagattttgcaacttattactgtcaac agtttaatagttacccgtacacttttggccaggggaccaagctgga gatcaaacgtacggtggctgcaccatctgtcttcatcttcccgcca tctgatgagcagttgaaatctggaactgcctctgttgtgtgcctgc tgaataacttctatcccagagaggccaaagtacagtggaaggtgga taacgccctccaatcgggtaactcccaggagagtgtcacagagcag gacagcaaggacagcacctacagcctcagcagcaccctgacgctga gcaaagcagactacgagaaacacaaagtctacgcctgcgaagtcac ccatcagggcctgagctcgcccgtcacaaagagcttcaacaggg gagagtgttag |
| 367 | Signal peptide | MRAWIFFLLCLAGRALA |
| 368 | Signal peptide nucleotide sequence | atgagggcttggatcttctttctgctctgcctggccgg gagagcgctcgca |
| 369 | Signal peptide nucleotide sequence | atgagggcttggatcttctttctgctctgcctggccgg gcgcgccttggcc |
| 370 | Human GITR fragment | QRPTGGPGCGPGRLLLGTGTDARCCRVHTTR |

TABLE 2-continued

SEQUENCES

| SEQ ID | Description | Sequence |
|---|---|---|
| 371 | 9G7 L1 (full length wild-type light chain 1) The constant region is underlined | EIVLTQSPGTLSLSPGERATLSCRASQSVSSSYLAWYQ QKPGQAPRLLIYGASSRATGIPDRFSGSGSGTDFTLTI SRLEPEDFAVYYCQQYGSSPWTFGQGTKVEIK<u>RTVAAP SVFIFPPSDEQLKSGTASVVCLLNNFYPREAKVQWKVD NALQSGNSQESVTEQDSKDSTYSLSSTLTLSKADYEKH KVYACEVTHQGLSSPVTKSFNRGEC</u> |
| 372 | degenerate VH CDR1 | SYGXH, wherein X is any amino acid |
| 373 | degenerate VH CDR2 | VIWYX$_1$GSNKX$_2$YADSVKG, wherein X$_1$ and X$_2$ are any amino acids |
| 374 | degenerate VH CDR2 | VIWYX$_1$GSNKX$_2$YX$_3$DSVKG, wherein X$_1$, X$_2$, and X$_3$ are any amino acids |
| 375 | degenerate VH CDR3 | GGSX$_1$VRGDYYYGMDV, wherein X$_1$ is any amino acid |
| 376 | degenerate VH CDR3 | GGSX$_1$VRGX$_2$YYYGMDV, wherein X$_1$ and X$_2$ are any amino acids |
| 377 | degenerate VH CDR3 | GG (6-7aa) MDVWYYX$_1$MDVW, wherein X$_1$ is any amino acid, and the 6-7 amino acids are any amino acids |
| 378 | degenerate VL CDR1 | RASQGISSXLA, wherein X is any amino acid |
| 379 | degenerate VL CDR1 | RASQG (2-3 aa) SX$_1$LA, wherein X1 is any amino acid, and the 2-3 amino acids are any amino acids |
| 380 | degenerate VL CDR2 | DASSLXS, wherein X is any amino acid |
| 381 | degenerate VL CDR3 | QQXNSYPYT, wherein X is any amino acid |
| 382 | degenerate VL CDR3 | QQX$_1$X$_2$SX$_3$PX$_4$T, wherein X$_1$, X$_2$, X$_3$, and X$_4$ are any amino acids |

The Table above provides the sequences of the mature variable regions and heavy and light chains and where indicated, sequences with signal peptides.

TABLE 3

| SEQ ID NO: | SEQUENCE |
|---|---|
| 383 | Heavy Chain Variable Region (VH) Amino Acid Sequence Anti-PD-L1 mAb (12A4; 12A4 in WO 2007/005874 and U.S. Pat. No. 7,943,743) QVQLVQSGAEVKKPGSSVKVSCKTSGDTFSTYAISWVRQAPGQGLEWMGGII PIFGKAHYAQKFQGRVTITADESTSTAYMELSSLRSEDTAVYFCARKFHFVS GSPFGMDVWGQGTTVTVSS |
| 384 | Heavy Chain Variable Region (VH) Nucleotide Sequence Anti-PD-L1 mAb (12A4; 12A4 in WO 2007/005874 and U.S. Pat. No. 7,943,743) cag gtc cag ctg gtg cag tct ggg gct gag gtg aag aag cct ggg tcc tcg gtg aag gtc tcc tgc aag act tct gga gac acc ttc agc acc tat gct atc agc tgg gtg cga cag gcc cct gga caa ggg ctt gag tgg atg gga ggg atc atc cct ata ttt ggt aaa gca cac tac gca cag aag ttc cag ggc aga gtc acg att acc gcg gac gaa tcc acg agc aca gcc tac |

TABLE 3-continued

| SEQ ID NO: | SEQUENCE |
|---|---|
| | atg gag ctg agc agc ctg aga tct gag gac acg gcc gtg tat ttt tgt<br>gcg aga aag ttt cac ttt gtt tcg ggg agc ccc ttc ggt atg gac gtc<br>tgg ggc caa ggg acc acg gtc acc gtc tcc |
| 385 | Light Chain Variable Region (VL) Amino Acid Sequence<br>Anti-PD-L1 mAb (12A4; 12A4 in WO 2007/005874 and U.S. Pat. No. 7,943,743)<br>EIVLTQSPATLSLSPGERATLSCRASQSVSSYLAWYQQKPGQAPRLLIY<br>DASNRATGIPARFSGSGSGTDFTLTISSLEPEDFAVYYCQQRSNWPTFG<br>QGTKVEIK |
| 386 | Light Chain Variable Region (VL) Nucleotide Sequence<br>Anti-PD-L1 mAb (12A4; 12A4 in WO 2007/005874 and U.S. Pat. No. 7,943,743)<br>gaa att gtg ttg aca cag tct cca gcc acc ctg tct ttg tct cca ggg<br>gaa aga gcc acc ctc tcc tgc agg gcc agt cag agt gtt agc agc tac<br>tta gcc tgg tac caa cag aaa cct ggc cag gct ccc agg ctc ctc atc<br>tat gat gca tcc aac agg gcc act ggc atc cca gcc agg ttc agt ggc<br>agt ggg tct ggg aca gac ttc act ctc acc atc agc agc cta gag cct<br>gaa gat ttt gca gtt tat tac tgt cag cag cgt agc aac tgg ccg acg<br>ttc ggc caa ggg acc aag gtg gaa atc aaa |
| 387 | Heavy Chain CDR1 Amino Acid Sequence<br>Anti-PD-L1 mAb (12A4; 12A4 in WO 2007/005874 and U.S. Pat. No. 7,943,743)<br>TYAIS |
| 388 | Heavy Chain CDR2 Amino Acid Sequence<br>Anti-PD-L1 mAb (12A4; 12A4 in WO 2007/005874 and U.S. Pat. No. 7,943,743)<br>GIIPIFGKAHYAQKFQ |
| 389 | Heavy Chain CDR3 Amino Acid Sequence<br>Anti-PD-L1 mAb (12A4; 12A4 in WO 2007/005874 and U.S. Pat. No. 7,943,743)<br>KFHFVSGSPFGMDV |
| 390 | Light Chain CDR1 Amino Acid Sequence<br>Anti-PD-L1 mAb (12A4; 12A4 in WO 2007/005874 and U.S. Pat. No. 7,943,743)<br>RASQSVSSYLA |
| 391 | Light Chain CDR2 Amino Acid Sequence<br>Anti-PD-L1 mAb (12A4; 12A4 in WO 2007/005874 and U.S. Pat. No. 7,943,743)<br>DASNRAT |
| 392 | Light Chain CDR3 Amino Acid Sequence<br>Anti-PD-L1 mAb (12A4; 12A4 in WO 2007/005874 and U.S. Pat. No. 7,943,743)<br>QQRSNWPT |
| 393 | Heavy Chain Amino Acid Sequence<br>Anti-PD-1 mAb (5C4 in WO 2006/121168)<br>(variable region underlined; constant region bold)<br><u>QVQLVESGGGVVQPGRSLRLDCKASGITFSNSGMHWVRQAPGKGL</u><br><u>EWVAVIWYDGSKRYYADSVKGRFTISRDNSKNTLFLQMNSLRAEDT</u><br><u>AVYYCATNDDYWGQGTLVTVSS</u>ASTKGPSVFPLAPCSRSTSESTAA<br>LGCLVKDYFPEPVTVSWNSGALTSGVHTFPAVLQSSGLYSLSSVVT<br>VPSSSLGTKTYTCNVDHKPSNTKVDKRVESKYGPPCPPCPAPEFLG<br>GPSVFLFPPKPKDTLMISRTPEVTCVVVDVSQEDPEVQFNWYVDGV<br>EVHNAKTKPREEQFNSTYRVVSVLTVLHQDWLNGKEYKCKVSNKG<br>LPSSIEKTISKAKGQPREPQVYTLPPSQEEMTKNQVSLTCLVKGFYPS<br>DIAVEWESNGQPENNYKTTPPVLDSDGSFFLYSRLTVDKSRWQEGNV<br>FSCSVMHEALHNHYTQKSLSLSLGK |

TABLE 3-continued

| SEQ ID NO: | SEQUENCE |
|---|---|
| 394 | Light Chain Amino Acid Sequence Anti-PD-1 mAb (5C4 in WO 2006/121168) (variable region underlined; constant region bold) <u>EIVLTQSPATLSLSPGERATLSCRASQSVSSYLAWYQQKPGQAPRLLI YDASNRATGIPARFSGSGSGTDFTLTISSLEPEDFAVYYCQQSSNWPR TFGQGTKVEIK</u>RTVAAPSVFIFPPSDEQLKSGTASVVCLLNNFYPREA KVQWKVDNALQSGNSQESVTEQDSKDSTYSLSSTLTLSKADYEKHK VYACEVTHQGLSSPVTKSFNRGEC |
| 395 | Heavy Chain Variable Region (VH) Amino Acid Sequence Anti-PD-1 mAb (5C4 in WO 2006/121168) (SEQ ID NO: 4 from WO 2006/121168) QVQLVESGGGVVQPGRSLRLDCKASGITFSNSGMHWVRQAPGKGLEWVAV IWYDGSKRYYADSVKGRFTISRDNSKNTLFLQMNSLRAEDTAVYYCATND DYWGQGTLVTVSS |
| 396 | Heavy Chain Variable Region (VH) Nucleotide Sequence Anti-PD-1 mAb (5C4 in WO 2006/121168) (SEQ ID NO: 60 from WO 2006/121168) cag gtg cag ctg gtg gag tct ggg gga ggc gtg gtc cag cct ggg agg tcc ctg aga ctc gac tgt aaa gcg tct gga atc acc ttc agt aac tct ggc atg cac tgg gtc cgc cag gct cca ggc aag ggg ctg gag tgg gtg gca gtt att tgg tat gat gga agt aaa aga tac tat gca gac tcc gtg aag ggc cga ttc acc atc tcc aga gac aat tcc aag aac acg ctg ttt ctg caa atg aac agc ctg aga gcc gag gac acg gct gtg tat tac tgt gcg aca aac gac gac tac tgg ggc cag gga acc ctg gtc acc gtc tcc tca |
| 397 | Light Chain Variable Region (VL) Amino Acid Sequence Anti-PD-1 mAb (5C4 in WO 2006/121168) (SEQ ID NO: 11 from WO 2006/121168) EIVLTQSPATLSLSPGERATLSCRASQSVSSYLAWYQQKPGQAPRLLIYD ASNRATGIPARFSGSGSGTDFTLTISSLEPEDFAVYYCQQSSNWPRTFGQ GTKVEIK |
| 398 | Light Chain Variable Region (VL) Nucleotide Sequence Anti-PD-1 mAb (5C4 in WO 2006/121168) (SEQ ID NO: 67 from WO 2006/121168) gaa att gtg ttg aca cag tct cca gcc acc ctg tct ttg tct cca ggg gaa aga gcc acc ctc tcc tgc agg gcc agt cag agt gtt agt agt tac tta gcc tgg tac caa cag aaa cct ggc cag gct ccc agg ctc ctc atc tat gat gca tcc aac agg gcc act ggc atc cca gcc agg ttc agt ggc agt ggg tct ggg aca gac ttc act ctc acc atc agc agc cta gag cct gaa gat ttt gca gtt tat tac tgt cag cag agt agc aac tgg cct cgg acg ttc ggc caa ggg acc aag gtg gaa atc aaa |
| 399 | Heavy Chain CDR1 Amino Acid Sequence Anti-PD-1 mAb (5C4 in WO 2006/121168) (SEQ ID NO: 18 from WO 2006/121168) NSGMH |
| 400 | Heavy Chain CDR2 Amino Acid Sequence Anti-PD-1 mAb (5C4 in WO 2006/121168) (SEQ ID NO: 25 from WO 2006/121168) VIWYDGSKRYYADSVKG |
| 401 | Heavy Chain CDR3 Amino Acid Sequence Anti-PD-1 mAb (5C4 in WO 2006/121168) (SEQ ID NO: 32 from WO 2006/121168) NDDY |

TABLE 3-continued

| SEQ ID NO: | SEQUENCE |
|---|---|
| 402 | Light Chain CDR1 Amino Acid Sequence Anti-PD-1 mAb (5C4 in WO 2006/121168) (SEQ ID NO: 39 from WO 2006/121168) RASQSVSSYLA |
| 403 | Light Chain CDR2 Amino Acid Sequence Anti-PD-1 mAb (5C4 in WO 2006/121168) (SEQ ID NO: 46 from WO 2006/121168) DASNRAT |
| 404 | Light Chain CDR3 Amino Acid Sequence Anti-PD-1 mAb (5C4 in WO 2006/121168) (SEQ ID NO: 53 from WO 2006/121168) QQSSNWPRT |
| 405 | Complete PD-1 sequence (GenBank Accession No.: U64863)<br>agtttccctt ccgctcacct ccgcctgagc agtggagaag gcggcactct<br>ggtggggctg ctccaggcat gcagatccca caggcgccct ggccagtcgt<br>ctgggcggtg ctacaactgg gctggcggcc aggatggttc ttagactccc<br>cagacaggcc ctggaacccc ccaccttct tcccagccct gctcgtggtg<br>accgaagggg acaacgccac cttcacctgc agcttctcca acacatcgga<br>gagcttcgtg ctaaactggt accgcatgag ccccagcaac cagacggaca<br>agctggccgc cttccccgag gaccgcagcc agcccggcca ggactgccgc<br>ttccgtgtca cacaactgcc caacgggcgt gacttccaca tgagcgtggt<br>cagggcccgg cgcaatgaca cggcaccta cctctgtggg gccatctccc<br>tggcccccaa ggcgcagatc aaagagagcc tgcgggcaga gctcagggtg<br>acagagagaa gggcagaagt gccacagcc accccagcc cctcacccag<br>gccagccggc cagttccaaa ccctggtggt tggtgtcgtg gcggcctgc<br>tgggcagcct ggtgctgcta gtctgggtcc tggccgtcat ctgctcccgg<br>gccgcacgag ggacaatagg agccaggcgc accggccagc ccctgaagga<br>ggaccctca gccgtgcctg tgttctctgt ggactatggg gagctggatt<br>tccagtggcg agagaagacc ccggagcccc ccgtgccctg tgtccctgag<br>cagacggagt atgccaccat tgtcttcct agcggaatgg gcacctcatc<br>ccccgcccgc aggggctcag ccgacggcc tcggagtgcc cagccactga<br>ggcctgagga tggacactgc tcttggcccc tctgaccggc ttccttggcc<br>accagtgttc tgcagaccc ccaccatgag cccgggtcag cgcatttcct<br>caggagaagc aggcagggtg caggccattg caggccgtcc aggggctgag<br>ctgcctgggg gcgaccgggg ctccagcctg cacctgcacc aggcacagcc<br>ccaccacagg actcatgtct caatgcccac agtgagccca ggcagcaggt<br>gtcaccgtcc cctacaggga gggccagatg cagtcactgc ttcaggtcct<br>gccagcacag agctgcctgc gtccagctcc ctgaatctct gctgctgctg<br>ctgctgctgc tgctgctgcc tgcggcccgg ggctgaaggc gccgtggccc<br>tgcctgacgc cccggagcct cctgcctgaa cttgggggct ggttggagat<br>ggccttggag cagccaaggt gcccctggca gtggcatccc gaaacgccct<br>ggacgcaggg cccaagactg ggcacaggag tgggaggtac atggggctgg<br>ggactcccca ggagttatct gctccctgca ggcctagaga agtttcaggg<br>aaggtcagaa gagctcctgg ctgtggtggg cagggcagga aacccctccc<br>acctttacac atgcccaggc agcacctcag gcccttttgtg gggcagggaa<br>gctgaggcag taagcgggca ggcagagctg gaggcctttc aggccagcca<br>gcactctggc ctcctgccgc cgcattccac cccagccct cacaccactc<br>gggagaggga catcctacgt tcccaaggtc aggagggcag ggctggggtt<br>gactcaggcc cctcccagct gtggccacct gggtgttggg agggcagaag<br>tgcaggcacc tagggccccc catgtgccca ccctgggagc tctccttgga<br>acccattcct gaaattattt aaaggggttg gccgggctcc caccagggcc<br>tgggtgggaa ggtacaggcg ttcccccggg gcctagtacc ccgcgtggc<br>ctatccactc ctcacatcca cacactgcac ccccactcct ggggcagggc<br>caccagcatc caggcggcca gcaggcacct gagtggctgg gacaagggat<br>cccccttccc tgtggttcta ttatattata attataatta aatatgagag<br>catgct |
| 406 | Human PD-L1 amino acid sequence-isoform a precursor (GenBank Accession No. NP_054862.1)<br>MRIFAVFIFM TYWHLLNAFT VTVPKDLYVV EYGSNMTIEC KFPVEKQLDL<br>AALIVYWEME DKNIIQFVHG EEDLKVQHSS<br>YRQRARLLKD QLSLGNAALQ ITDVKLQDAG VYRCMISYGG<br>ADYKRITVKV NAPYNKINQR ILVVDPVTSE HELTCQAEGY PKAEVIWTSS<br>DHQVLSGKTT TTNSKREEKL FNVTSTLRIN<br>TTTNEIFYCT FRRLDPEENH TAELVIPELP LAHPPNERTH<br>LVILGAILLC LGVALTFIFR LRKGRMMDVK KCGIQDTNSK KQSDTHLEET |
| 407 | Human PD-L1 amino acid sequence-isoform b precursor (GenBank Accession No. NP_001254635.1)<br>MRIFAVFIFM TYWHLLNAPY NKINQRILVV DPVTSEHELT CQAEGYPKAE<br>VIWTSSDHQV LSGKTTTTNS KREEKLFNVT |

TABLE 3-continued

| SEQ ID NO: | SEQUENCE |
|---|---|
| | STLRINTTTN EIFYCTFRRL DPEENHTAEL VIPELPLAHP PNERTHLVIL GAILLCLGVA LTFIFRLRKG RMMDVKKCGI QDTNSKKQSD THLEET |

The present disclosure is further illustrated by the following examples, which should not be construed as further limiting. The contents of all figures and all references, Genbank sequences, patents and published patent applications cited throughout this application are expressly incorporated herein by reference. In particular, the disclosures of PCT publications WO 09/045957, WO 09/073533, WO 09/073546, WO 09/054863, PCT/US2013/072918, WO16168716, PCT/US2015/033991 (W015/187,835), WO16081746, WO16196792, WO17087678, U.S. Pat. No. 9,228,016 (application Ser. No. 14/732,082) and U.S. Patent Publication No. 2011/0150892 are expressly incorporated herein by reference.

EXAMPLES

Example 1: Anti-GITR Agonist Abs for Treatment of Advanced Solid Tumors

Anti-GITR agonist Ab 28F3.IgG1 will be administered to subjects with advanced solid tumors to determine safety, tolerability and efficacy. When referring to administration of an anti-GITR Ab in this and the next Examples, the anti-GITR Ab is Ab 28F3.IgG1 (i.e., having full length heavy chain and light chain amino acid sequences of SEQ ID NOs: 17 and 19 (Table 2), respectively). A Phase ½a dose escalation and cohort expansion study for safety, tolerability, and efficacy of anti-GITR agonist Ab 28F3.IgG1 administered alone and in combination with nivolumab (BMS-936558; anti-PD-1 monoclonal antibody) in advanced solid tumors. ORR, duration of response and progression free survival rate (PFSF) will be measured at 24 weeks based on tumor measurements every 8 weeks during treatment, response and survival in follow up periods.

Each subject will be administered IV doses of 28F3.IgG1 at dose levels of 10, 30, 100, 240, or 800 mg once every 2 weeks, in 8-week cycles, for up to 3 cycles of study therapy. Certain patients will receive a combination therapy including 10, 30, 100, 240, or 800 mg of 28F3.IgG1 once every 2 weeks in combination with nivolumab which will be administered at a dose of 240 mg once every 2 weeks, in 8-week cycles, for up to 3 cycles of study therapy. 1 mg and 3 mg of 28F3.IgG1 may also be given.

Additional cycles of treatment beyond 3 cycles (for up to a total of 6 cycles) or re-treatment with monotherapy or combination therapy during the follow-up period within 12 months of the last dose of study therapy, at the dose and regimen assigned at study entry, may be administered.

28F3.IgG1 will be administered in 2 disease-restricted populations: (i) NSCLC subjects with progressive or recurrent disease during or after prior platinum doublet-based chemotherapy, followed by recurrent or progressive disease (per RECIST v1.1) during or after subsequent anti-PD-1 or anti-PD-L1 therapy, and (ii) persistent, recurrent or metastatic cervical cancer.

28F3.IgG1 will be administered in disease-restricted populations as follows: (i) NSCLC subjects with progressive or recurrent disease during or after prior platinum doublet-based chemotherapy followed by progressive or recurrent disease (per RECIST v1.1) during or after subsequent anti-PD-1 or anti-PD-L1 therapy, (ii) NSCLC subjects with progressive or recurrent disease during or after platinum doublet-based chemotherapy with no prior anti-PD-1 or anti-PD-L1 therapy, and (iii) persistent, recurrent or metastatic cervical cancer.

28F3.IgG1 and nivolumab will be administered as an IV infusion over 60 minutes every 2 weeks. Treatment periods will consist of up to three, 8-week treatment cycles. Each treatment cycle will comprise 4 doses of 28F3.IgG1 administered every 2 weeks on Days 1, 15, 29, and 43 of the treatment cycle. In treatments with nivolumab, each treatment cycle will comprise 4 doses of 28F3.IgG1 (administered on Days 1, 15, 29 and 43) in combination with 4 doses of nivolumab administered on Days 1, 15, 29, and 43 of the treatment cycle. When both 28F3.IgG1 and nivolumab will be given, nivolumab will be given first followed by 28F3.IgG1 at least 30 minutes after completion of the infusion of nivolumab.

The following combinations will be administered to patients having advanced solid tumors:

TABLE 4

| 28F3.IgG1 | Nivolumab |
|---|---|
| 1 mg | 240 mg IV q 2 weeks |
| 3 mg | 240 mg IV q 2 weeks |
| 10 mg | 240 mg IV q 2 weeks |
| 30 mg | 240 mg IV q 2 weeks |
| 100 mg | 240 mg IV q 2 weeks |
| 240 mg | 240 mg IV q 2 weeks |
| 800 mg | 240 mg IV q 2 weeks |

Intermediate or lower doses, or less frequent dosing of 28F3.IgG1 may be tested if none of the planned doses/schedules are found to be tolerated as monotherapy or in combination with nivolumab.

For certain treatments, subjects must have one of the following tumor types to be eligible: post-chemotherapy NSCLC or advanced/metastatic cervical cancer.

The following inclusion and exclusion criteria will be used:

Inclusion Criteria:
1. Consent for tumor biopsy samples
2. Should have ECOG performance status of ≤1
3. Presence of at least one lesion with measurable disease as defined by RECIST v1.1 for solid tumors for response assessment. Subjects with lesions in a previously irradiated field as the sole site of measurable disease will be permitted to enroll provided the lesion(s) have demonstrated clear progression and can be measured accurately
4. Subjects with prior exposure to therapy with any agent specifically targeting checkpoint pathway inhibition (such as anti-PD-1, anti-PD-L1, anti-PDL-2, anti-LAG-3, anti- CTLA-4 antibody) are permitted after a washout period of any time greater than 4 weeks from the last treatment.
5. Subjects with prior therapy with any agent specifically targeting T-cell co-stimulation pathways except anti-GITR antibody, such as anti-CD137, anti-OX40 antibody, are permitted after a washout period of any time greater than 4 weeks from the last treatment
6. Prior palliative radiotherapy must have been completed at least 2 weeks prior to first dose of study drug. Subjects with symptomatic tumor lesions at baseline that may require palliative radiotherapy within 4 weeks of first dose of study drug are strongly encouraged to receive palliative radiotherapy prior to enrollment
7. Subjects must consent to allow the acquisition of fresh tumor biopsy or existing formalin-fixed paraffin-embedded (FFPE) material, either a block or at least 15-20 unstained slides, for performance of correlative studies
8. Adequate organ function for subjects with solid tumor histologies as defined by the following:
    a. WBC≥2000/μL (stable off any growth factor within 4 weeks of first study drug administration)
    b. Neutrophils≥1500/μL (stable off any growth factor within 4 weeks of first study drug administration)
    c. Platelets≥100×10³/μL (transfusion to achieve this level is not permitted within 2 weeks of first study drug administration)
    d. Hemoglobin≥8.5 g/dL (transfusion to achieve this level is not permitted within 2 weeks of first study drug administration)
    e. ALT and AST≥3× ULN
    f. Total bilirubin≤1.5× ULN (except subjects with Gilbert's Syndrome who must have normal direct bilirubin)
    g. Normal thyroid function, subclinical hypothyroidism (TSH<10 mIU/mL) or have controlled hypothyroidism on appropriate thyroid supplementation
    h. Serum creatinine≤1.5× ULN or creatinine clearance (CrCl)≥40 ml/min (measured using the Cockcroft-Gault)
9. Ability to comply with treatment, PK and PD sample collection, and required study follow-up.
10. Dose Escalation:
    a. Subjects must have received, and then progressed or been intolerant to, at least one standard treatment regimen in the advanced or metastatic setting, if such a therapy exists. Subjects who refuse or are ineligible for standard therapy will be allowed to enroll provided their refusal/ineligibility is documented in medical records.
    b. All solid tumor histologies will be permitted except for subjects with primary CNS tumors, or with CNS metastases as the only site of active disease.
11. Dose Expansion:
    a. Non-Small Cell Lung Cancer (NSCLC)
        i. All subjects must have had progressive or recurrent disease during or after platinum doublet-based chemotherapy.
        ii. All subjects with non-squamous histology must have known EGFR and ALK status.
        iii. Subjects with an activating EGFR mutation must have received an EGFR tyrosine kinase inhibitor.
        iv. Subjects with an ALK translocation must have received an ALK inhibitor
    b. Cervical Cancer
        i. Persistent, recurrent or metastatic cervical cancer with documented disease progression
        ii. Squamous, adenosquamous or adenocarcinoma histology—confirmation of the original primary tumor is required
        iii. Must have had one prior systemic chemotherapeutic regimen (e.g. paclitaxel/cisplatin, paclitaxel/cisplatin/bevacizumab) for persistent, recurrent, or metastatic disease. Chemotherapy administered concurrently with primary radiation (e.g. weekly cisplatin), adjuvant chemotherapy given following completion of radiation therapy or as concurrent chemotherapy and radiation therapy (e.g. paclitaxel and carboplatin for up to 4 cycles) is not counted as a systemic chemotherapy regimen
        iv. Confirmation of tumor HPV status: Prior testing results are acceptable if known. If tumor HPV status is unknown, subjects must consent to allow their submitted archived tumor tissue sample in the form of block or unstained slides to be tested for confirmation of tumor HPV status Exclusion Criteria:
1. Subjects with known or suspected central nervous system (CNS) metastases, untreated CNS metastases, or with the CNS as the only site of disease are excluded. However, subjects with controlled brain metastases will be allowed to enroll. Controlled brain metastases are defined as no radiographic progression for at least 4 weeks following radiation and/or surgical treatment (or 4 weeks of observation if no intervention is clinically indicated), and off of steroids for at least 2 weeks, and no new or progressive neurological signs and symptoms.
    a. Subjects with carcinomatous meningitis
    b. Participation in any prior clinical study with nivolumab, including subjects in comparator arms, in which overall survival is listed as the primary or co-primary endpoint and which has not completed analysis based on the primary endpoint.
2. Subjects with a prior malignancy are excluded (except non-melanoma skin cancers, and in situ cancers such as the following: bladder, colon, cervical/dysplasia, melanoma, or breast). Subjects with other second malignancies diagnosed more than 2 years ago who have received therapy with curative intent with no evidence of disease during the interval who are considered by the investigator to present a low risk for recurrence will be eligible.
3. Other active malignancy requiring concurrent intervention
4. Prior organ allograft
5. Any anti-cancer therapy (e.g., chemotherapy, biologics, vaccines, or hormonal treatment) including investigational drugs within 4 weeks prior to the first dose of study drug administration, with the exception of GnRH agonist therapy for subjects with prostate cancer and anti-cancer therapies with half-life <4 weeks (e.g. prior use of EGFR TKI (completed at least two weeks prior to first dose of study drug is acceptable).
6. Prior therapy with anti-GITR antibody
7. Subjects with active, known or suspected autoimmune disease. Subjects with vitiligo, type I diabetes mellitus, residual hypothyroidism due to autoimmune condition only requiring hormone replacement, euthyroid patients with a history of Grave's disease (subjects with suspected autoimmune thyroid disorders must be negative for thyroglobulin and thyroid peroxidase antibodies and thyroid stimulating immunoglobulin prior to first dose of study drug), psoriasis not requiring systemic treatment, or conditions not expected to recur in the absence of an external trigger are permitted to enroll.

8. Subjects with interstitial lung disease that is symptomatic or may interfere with the detection or management of suspected drug-related pulmonary toxicity
9. Chronic Obstructive Pulmonary Disease requiring recurrent steroids bursts or chronic steroids at doses greater than 10 mg/day of prednisone or the equivalent
10. Subjects with a condition requiring systemic treatment with either corticosteroids (>10 mg daily prednisone equivalents) or other immunosuppressive medications within 14 days of study drug administration except for adrenal replacement steroid doses >10 mg daily prednisone equivalent in the absence of active autoimmune disease. Treatment with a short course of steroids (<5 days) up to 7 days prior to initiating study drug is permitted.
11. Uncontrolled or significant cardiovascular disease including, but not limited to any of the following:
    a. myocardial infarction or stroke/TIA within the past 6 months
    b. uncontrolled angina within the past 3 months
    c. any history of clinically significant arrhythmias (such as ventricular tachycardia, ventricular fibrillation or torsades de pointes)
    d. QTcF prolongation>480 msec
    e. history of other clinically significant heart disease (e.g., cardiomyopathy, congestive heart failure with NYHA functional classification III-IV, pericarditis, significant pericardial effusion)
    f. requirement for daily supplemental oxygen therapy
12. History of any chronic hepatitis as evidenced by:
    a. Positive test for hepatitis B surface antigen (HBsAg)
    b. Positive test for qualitative hepatitis C viral load (by PCR)
13. Any major surgery within 4 weeks of study drug administration. Subjects must have recovered from the effects of major surgery or significant traumatic injury at least 14 days before the first dose of study drug
14. Use of non-oncology vaccines containing live virus for prevention of infectious diseases within 12 weeks prior to study drug. The use of inactivated seasonal influenza vaccines e.g. Fluzone® will be permitted on study without restriction.
15. Use of pRBC or platelet transfusion within 2 weeks prior to the first dose of study drug.

Example 2: Phase ½a Study of 28F3.IgG1 Given Alone and in Combination with Nivolumab in Subjects with Advanced Solid Tumors Purpose The purpose of this study is to evaluate the safety, tolerability pharmacokinetics, pharmacodynamics, immunogenicity and preliminary anti-tumor activity of 28F3.IgG1 when administered alone and in combination with nivolumab in subjects with advanced solid tumors.

TABLE 5

| Condition | Intervention | Phase |
|---|---|---|
| Cervical Cancer | Drug: 28F3.IgG1 | Phase 1/Phase 2 |
| Non-Small Cell Lung Cancer | Drug: Nivolumab | |

Study Type: Interventional

Study Design: Treatment, Parallel Assignment, Open Label, Non-Randomized, Safety/Efficacy Study Official Title: A Phase 1/2a Dose Escalation and Cohort Expansion Study for Safety, Tolerability, and Efficacy of Anti-GITR Monoclonal Antibody (28F3.IgG1) Administered Alone and in Combination With Nivolumab (BMS-936558, Anti PD-1 Monoclonal Antibody) in Advanced Solid Tumors.

Further Study Details:

Primary Outcome Measure:

Safety of 28F3.IgG1 based on number of incidence of adverse events (AEs), serious adverse events (SAEs), adverse events leading to discontinuation and deaths in addition to clinical laboratory test abnormalities [Time Frame: Up to 30 days after the last dose of study drug]

Secondary Outcome Measures:

Objective response rate (ORR) [Time Frame: Every 8 weeks during treatment]ORR is defined as the proportion of all treated subjects whose best overall response is either a complete response (CR) or partial response (PR)

Progression free survival rate (PFSR) [Time Frame: Every 8 weeks during treatment] The proportion of treated subjects remaining progression free and surviving at 24 weeks. The proportion will be calculated by the K-M estimate which takes into account censored data Duration of response [Time Frame: Every 8 weeks during treatment] Duration of response is defined as the time between the date of first response and the date of disease progression or death, whichever occurs first Maximum observed concentration (Cmax) of 28F3.IgG1 [Time Frame: Day 1 to 56 days]

Time of maximum observed concentration (Tmax) of 28F3.1gG1 [Time Frame: Day 1 to 56 days]

Area under the concentration-time curve in one dosing interval (AUC [TAU]) of 28F3.1gG1 [Time Frame: Day 1 to 56 days]

Area under the plasma concentration-time curve from time zero to time of last quantifiable concentration (AUC(0-T) of 28F3.1gG1 [Time Frame: Day 1 to 56 days]

Anti-drug antibody (ADA) response to 28F3.1gG1 [Time Frame: Day 1 to 56 days]

Anti-drug antibody response to 28F3.IgGland Nivolumab [Time Frame: Day 1 to 56 days]

TABLE 6

| Arms | Assigned Interventions |
|---|---|
| Experimental: Mono therapy - 28F3.IgG1 (Dose Escalation) 28F3.IgG1 dose as specified | Drug: 28F3.IgG1 |
| Experimental: Combination therapy - 28F3.IgG1 + Nivolumab (Dose Escalation) 28F3.IgG1 + Nivolumab dose as specified | Drug: 28F3.IgG1 Drug: Nivolumab |
| Experimental: Mono therapy - 28F3.IgG1 (Dose Expansion) 28F3.IgG1 dose as specified | Drug: 28F3.IgG1 |
| Experimental: Combination therapy - 28F3.IgG1 + Nivolumab (Dose Expansion) 28F3.IgG1 + Nivolumab dose as specified | Drug: 28F3.IgG1 Drug: Nivolumab |

Eligibility:
Ages Eligible for Study: 18 Years and older
Genders Eligible for Study: Both
Inclusion Criteria:
 For Dose Escalation:
  i) Subjects with any previously treated advanced (metastatic or refractory) solid tumor
 For Cohort Expansion:
  i) Subjects must have a previously treated advanced solid tumor to be eligible
 Eastern Cooperative Oncology Group (ECOG) performance status of 0 or 1
 Willing and able to provide pre-treatment and on-treatment fresh tumor biopsy
 Women of child-bearing potential and men must use an acceptable method of contraception during treatment and for 23 weeks after treatment for women and 31 weeks for men
Exclusion Criteria:
 Known central nervous system metastases or central nervous system as the only source of disease
 Other concomitant malignancies (with some exceptions per protocol)
 Active, known or suspected autoimmune disease
 Uncontrolled or significant cardiovascular disease
 History of chronic hepatitis
 History of active hepatitis (B or C)
 Impaired liver or bone marrow function
 Major surgery less than 1 month before start of the study.

Example 3: Preliminary Results of a Phase 1/2a Study of 28F3.IgG1 (Glucocorticoid-Induced Tumor Necrosis Factor Receptor-Related Gene [GITR] Agonist), Alone and in Combination with Nivolumab in Patients with Advanced Solid Tumors Background: 28F3.IgG1 is a fully human IgG1 agonist mAb that binds GITR and promotes T effector cell activation and possible reduction/inactivation of T regulatory cells. Preclinical data show enhanced antitumor T-cell activity with anti-GITR+anti-programmed death-1 (PD-1). Here we describe preliminary dose escalation data from a phase 1/2a study of 28F3.IgG1±nivolumab (anti-PD-1 mAb) in patients with advanced solid tumors. Methods: During dose escalation, patients received 28F3.IgG1 (10-800 mg) or 28F3.IgG1 (30-800 mg)+nivolumab (240 mg) every 2 weeks (FIG. 1). Objectives included safety (primary), immunogenicity, pharmacokinetics (PK), pharmacodynamics (PD), and efficacy.

Results: As of Dec 12, 2016, 66 patients were treated with 28F3.IgG1 (n=29) or 28F3.IgG1+nivolumab (n=37). No dose-limiting toxicities (DLTs) were reported during dose escalation. The most common treatment-related adverse events reported with 28F3.IgG1/28F3.IgG1+nivolumab included pyrexia (21%/30%), chills (10%/16%), and fatigue (14%/14%); events were G½ in all patients except for 4 patients (6%) treated with the combination (G3 lipase [n=1], G3 lung infection [n=1], G3 fatigue [n=1], and G3 aspartate aminotransferase with G4 creatine phosphokinase [n=1; leading to discontinuation of treatment]). Preliminary data indicate that the incidence of immunogenicity to 28F3.IgG1 was low when 28F3.IgG1±nivolumab was administered. Preliminary data also indicate that 28F3.IgG1±nivolumab exhibits linear PK with dose proportionality after a single dose, and 28F3.IgG1±nivolumab is biologically active in PD analyses in peripheral blood. Initial antitumor activity has been observed in several patients treated with the combination.

Conclusions: This is the first report of clinical data with an anti-GITR mAb±a PD-1 inhibitor. 28F3.IgG1±nivolumab was well tolerated, with no DLTs and low immunogenicity. Antitumor activity was observed with 28F3.IgG1+nivolumab at doses predicted to be biologically active. Further evaluation of this combination in patients with advanced solid tumors is ongoing.

Example 4: Baseline Demographics, Prior Therapy, and Treatment Exposure

Table 7 provides information on the patients involved in the clinical trial described in Examples 1 to 3.

TABLE 7

Baseline demographics, prior therapy, and treatment exposure

| | GITR Ab All Mono (n = 29) | GITR Ab + Nivolumab All Combo (n = 37) |
|---|---|---|
| Median age (range), years | 56 (28-74) | 59 (21-87) |
| ECOG performance status, n | | |
| 0 | 14 | 13 |
| 1 | 15 | 24 |
| Tumor type, n | | |
| Melanoma | 6 | 1 |
| Cervical | 3 | 4 |
| Colon | 3 | 2 |
| Breast | 2 | 2 |
| Cholangiocarcinoma | 2 | 1 |
| Renal | 1 | 2 |
| Pancreatic | 1 | $2^a$ |
| Ovarian | 0 | 3 |
| Other (≤2 patients) | 14 | 23 |
| Number of prior therapies, n | | |
| 1 | 12 | 15 |
| 2 | 5 | 2 |
| ≥3 | 9 | 17 |
| Prior anti-PD-1/PD-L1, n | 7 | 5 |

$^a$Includes 1 patient with adenocarcinoma of the ampulla of Vater.

Median duration of treatment ranged from 7 to 15.5 weeks with 28F3.IgG1 monotherapy and 8 to 18 weeks with 28F3.IgG1+nivolumab (duration was longer with the 240/240 mg and 800/240 mg doses).

Example 5: 28F3.IgG1±Nivolumab is Well Tolerated

This Example describes any adverse events observed during the clinical trial described in Examples 1-4.

No Dose Related Toxicities (DLTs) or treatment-related deaths were observed, and safety with 28F3.IgG1+nivolumab is consistent with that observed in prior studies of nivolumab monotherapy. The presence or absence of treatment Related Adverse Events (TRAEs) of all patients are listed in Table 8.

TABLE 8

| | GITR Ab | GITR Ab + Nivolumab | | | | |
|---|---|---|---|---|---|---|
| | All Mono n = 29 | All Mono n = 37 | 30/240 mg n = 3 | 100/240 mg n = 9 | 240/240 mg n = 14 | 800/240 mg n = 11 |
| Any treatment-related AE (TRAE), n (%) | 17(59) | 26(70) | 2(67) | 6(67) | 9(64) | 9(82) |
| Grade 1 or 2 TRAEs in >2 patients in either regimen, n | | | | | | |
| Pyrexia | 6 | 12 | 2 | 2 | 3 | 5 |
| Chills | 3 | 7 | 0 | 2 | 3 | 2 |
| Fatigue | 3 | 6 | 0 | 1 | 2 | 3 |
| Nausea | 5 | 3 | 0 | 1 | 1 | 1 |
| Myalgia | 1 | 6 | 0 | 2 | 2 | 2 |
| Arthralgia | 2 | 4 | 0 | 1 | 2 | 1 |
| Diarrhea | 2 | 3 | 0 | 0 | 1 | 2 |
| Decreased appetite | 1 | 3 | 1 | 0 | 0 | 2 |
| Infusion-related reaction | 1 | 3 | 0 | 1 | 0 | 2 |
| Any grade 3 or 4 TRAE, n | | | | | | |
| Blood CPK increased[a,b,c,d] | 0 | 1 | 0 | 0 | 0 | 1 |
| Colitis[d] | 0 | 1 | 0 | 0 | 1 | 0 |
| Dehydration[a] | 0 | 1 | 1 | 0 | 0 | 0 |
| Fatigue | 0 | 1 | 0 | 0 | 1 | 0 |
| Hepatic enzyme increased[a,b] | 0 | 1 | 0 | 0 | 0 | 1 |
| Lipase increased | 0 | 1 | 0 | 1 | 0 | 0 |
| Lung Infection | 0 | 1 | 0 | 1 | 0 | 0 |

[a] Serious TRAE. Other serious TRAEs were grade 2 pneumonitis (800 mg) and grade 2 nephritis (100/240 mg).
[b] Events occurred in same patient.
[c] Grade 4 TRAE.
[d] Discontinued due to TRAE.

Safety with 28F3.IgG1+nivolumab is consistent with that observed in prior studies of nivolumab monotherapy (Brahmer J et al. *New Engl J Med.* 2015; 373:123-135. Motzer R J et al. *New Engl J Med.* 2015; 373:1803-1813. Ferris R L et al. *New Engl J Med.* 2016; 375:1856-1867).

Example 6: 28F3.IgG1±Nivolumab Demonstrates Linear PK and Low Immunogenicity This Example provides PK and immunogenicity data from patients involved in the clinical trial described in Examples 1 to 5.

Figure 2:
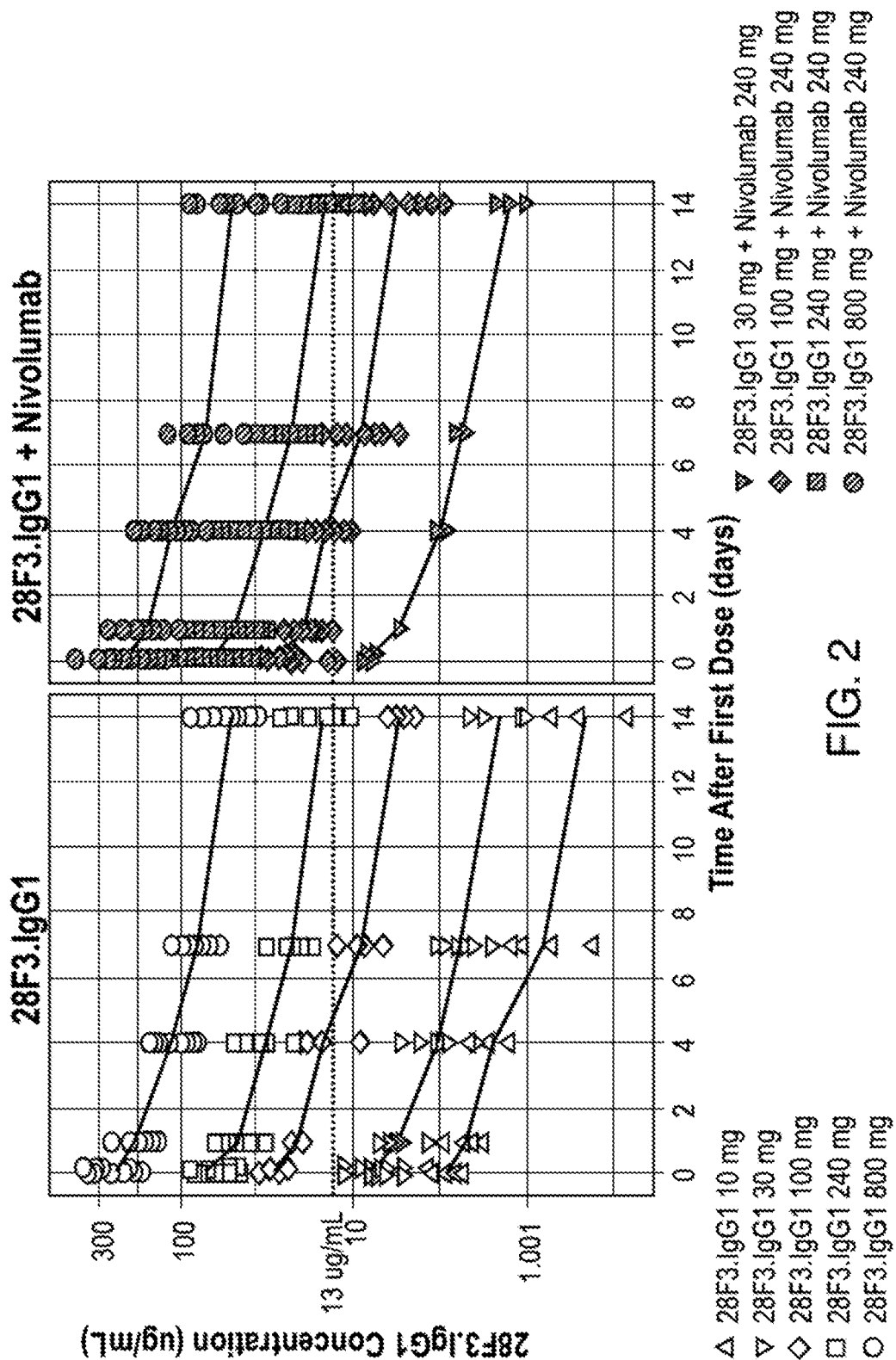
FIG. 2 shows that GITR Ab and nivolumab demonstrate a linear PK and low immunogenicity. The concentration of GITR Ab is shown as a function of time and concentration of GITR Ab with or without nivolumab after administration of the first dose. The concentrations from bottom to top lines for the monotherapy are 10 mg, 30 mg, 100 mg, 240 mg and 800 mg. The concentrations from bottom to top lines for the GITR Ab and nivolumab are 30 mg, 100 mg, 240 mg and 800 mg (administered with 240 mg of nivolumab).

FIG. 2 shows the GITR Ab (28F3.IgG1) concentration (μg/ml) at various times (in days) following administration of the first dose in patients treated with the GITR Ab or GITR Ab and nivolumab. The plots in FIG. 2 show that:
- PK is linear and not affected by combination with 240 mg nivolumab;
- 240 mg-dose (±nivolumab; steady state levels) exceeds the concentration estimated to be biologically active in preclinical studies (13 μg/mL; dotted line); and
- Immunogenicity was low and no patients had persistent positive anti-drug antibodies.

In addition, the PK of GITR Ab monotherapy is linear at dose range 10-800 mg, and the half-life of the antibody is 9-12 days.

Example 7: 28F3.IgG1±Nivolumab Increases Proliferating (Ki67+) NK and CD8 Cells in Peripheral Blood This Example provides PD data from patients involved in the clinical trial described in Examples 1 to 6.

Figure 3:
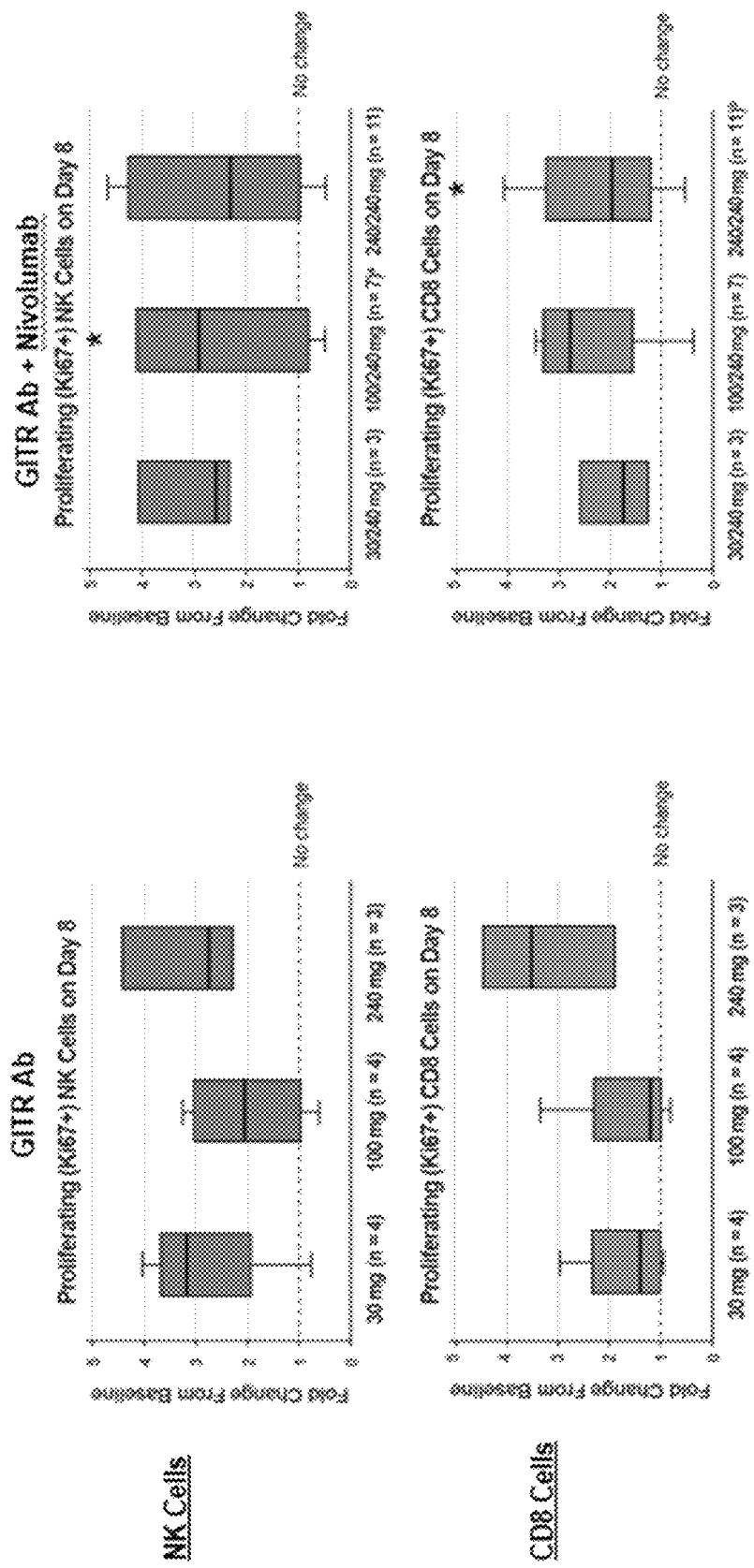
FIG. 3 shows that 28F3.IgG1+nivolumab increase proliferating (Ki67+) NK and CD8 cells in peripheral blood. [a]Asterisk denotes outlier at 10.9. [b]Asterisk denotes outlier at 7.8.

At day 8 following administration of the first dose of GITR Ab or GITR Ab and nivolumab to patients, GITR Ab with or without nivolumab increases proliferating (Ki67+) NK and CD8 cells in the peripheral blood of patients (see FIG. 3). Proliferating CD8+ T cell levels were determined by measuring the level of CD45+CD3+CD4-CD8+Ki67+ cells. Ki67 positive cells were detected with the anti-Ki-67 antibody PerCP5.5 (clone B56; Cat #561284, BD Biosciences).

The following protocol was used for flow cytometric analysis of proliferating NK cells. Blood samples were collected by direct vein puncture and collected in Streck Cytochex BCT tubes. Collection of the blood in these tubes allows the samples to be accurately analyzed up to 72 hour post blood collection. An aliquot was taken for TBNK (BD biosciences) analysis for downstream calculation of absolute counts of discreet cell populations. The remainder of the sample was subjected to lysing of the red blood cells using the standard BD pharmlyse procedure. The cells were then stained using fluorescently labeled antibodies specific for surface antigens CD45-ApC-H7 (2D1, BD biosciences), CD3-AF700 (SK7, Biolegend), CD16-BV510 (3G8, BD biosciences), CD27-BV605 (0323, Biolegend), CD56-AF647 (HCD56, Biolegend), CD94-FITC (DX22, Biolegend), NKp46-BV421 (9E2, BD biosciences), HLA-DR-BV650 (G46-6, BD biosciences), TIM-3-PE (344823, R&D systems), NKG2D-PE-CF594 (1D11, BD biosciences), and CD57-PE-Cy7 (TB01, ebiosciences). After surface staining, the samples were fixed and permeablized using the standard protocol for BD biosciences Cytofix/Cytoperm reagent. The presence of Ki67 was measured using a specific anti-Ki67 antibody labeled with PerCP5.5 (B56, BD biosciences). The samples were then acquired on a Beckman Coulter Cytoflex S flow cytometer, and the resulting data was analyzed using FlowJo software (TreeStar). Antibodies used are set forth in the following table:

TABLE 9

| Antigen | Clone | Label | Cat # | Supplier |
|---------|-------|-------|-------|----------|
| CD94 | DX22 | FITC | 305504 | Biolegend |
| Ki-67 | B56 | PerCP5.5 | 561284 | BD biosciences |
| CD56 | HCD56 | AF647 | 318314 | Biolegend |
| CD3 | SK7 | AF700 | 344822 | Biolegend |
| CD45 | 2D1 | APC-H7 | 560178 | BD biosciences |
| NKp46 | 9E2 | BV421 | 564065 | BD biosciences |
| CD16 | 3G8 | BV510 | 563830 | BD biosciences |
| CD27 | O323 | BV605 | 302830 | Biolegend |
| HLA-DR | G46-6 | BV650 | 564231 | BD biosciences |
| TIM-3 | 344823 | PE | FAB2365P | R&D Systems |
| NKG2D | 1D11 | PE-CF594 | 562498 | BD biosciences |
| CD57 | TB01 | PE Cy-7 | 25-0577-42 | ebioscience |

Proliferating NK cells are CD45 + CD3 − CD56 + Ki67+.

The following protocol was used for flow cytometric analysis of proliferating CD8 cells. Blood samples were collected by direct vein puncture and collected in Streck Cytochex BCT tubes. Collection of the blood in these tubes allows the samples to be accurately analyzed up to 72 hour post blood collection. An aliquot was taken for TBNK (BD biosciences) analysis for downstream calculation of absolute counts of discreet cell populations. The remainder of the sample was subjected to lysing of the red blood cells using the standard BD pharmlyse procedure. The cells were then stained using fluorescently labeled antibodies specific for surface antigens CD45-ApC-H7 (2D1, BD biosciences), CD3-AF700 (SK7, Biolegend), CD4-BV510 (OKT4, Biolegend), CD8a-BV605 (RPA-T8, BD biosciences), CD27-AF647 (0323, Biolegend), CD45RA-BB515 (HI100, BD biosciences), CD197-BV421 (G043H7, Biolegend), HLA-DR-BV650 (G46-6, BD biosciences), PD-1-PE (MIH4, eBiosciences), CD38-PE Dazzle 594 (HB7, Biolegend), and CD152-PE-Cy7 (BNI3, BD biosciences). After surface staining, the samples were fixed and permeablized using the standard protocol for BD biosciences Cytofix/Cytoperm reagent. The presence of Ki67 was measured using a specific anti-Ki67 antibody labeled with PerCP5.5 (B56, BD biosciences). The samples were then acquired on a Beckman Coulter Cytoflex S flow cytometer, and the resulting data was analyzed using FlowJo software (TreeStar). Antibodies used are set forth in the following table:

TABLE 10

| Antigen | Clone | Label | Cat # | Supplier |
|---------|-------|-------|-------|----------|
| CD45RA | HI100 | BB515 | 564552 | BD Biosciences |
| Ki-67 | B56 | PerCP5.5 | 561284 | BD Biosciences |
| CD197 | GO43H7 | BV421 | 353208 | Biolegend |
| CD4 | OKT4 | BV510 | 300546 | Biolegend |
| CD8a | RPA-T8 | BV605 | 563821 | BD Biosciences |
| HLA-DR | G46-6 | BV650 | 563965 | BD Biosciences |
| CD27 | O323 | AF647 | 302812 | Biolegend |
| CD3 | SK7 | AF700 | 344822 | Biolegend |
| CD45 | 2D1 | APC-H7 | 560178 | BD Biosciences |
| PD1 | MIH4 | PE | 12-9969-42 | eBiosciences |
| CD38 | HB7 | PE Dazzle 594 (TR) | 331226 | Biolegend |
| CD152 | BNI3 | PE-Cy7 | 560651 | BD Biosciences |

CD8 Proliferating CD8+ cells are CD45 + CD3 + CD4 − CD8 + Ki67+.

The results show that GITR Ab is biologically active at 30 mg-240 mg alone and in combination with nivolumab.

Example 8: 28F3.IgG1+Nivolumab Increases Proliferation and Activation of CD8 Memory Cells This Example provides PD data from patients involved in the clinical trial described in Examples 1 to 7.

Figure 4:
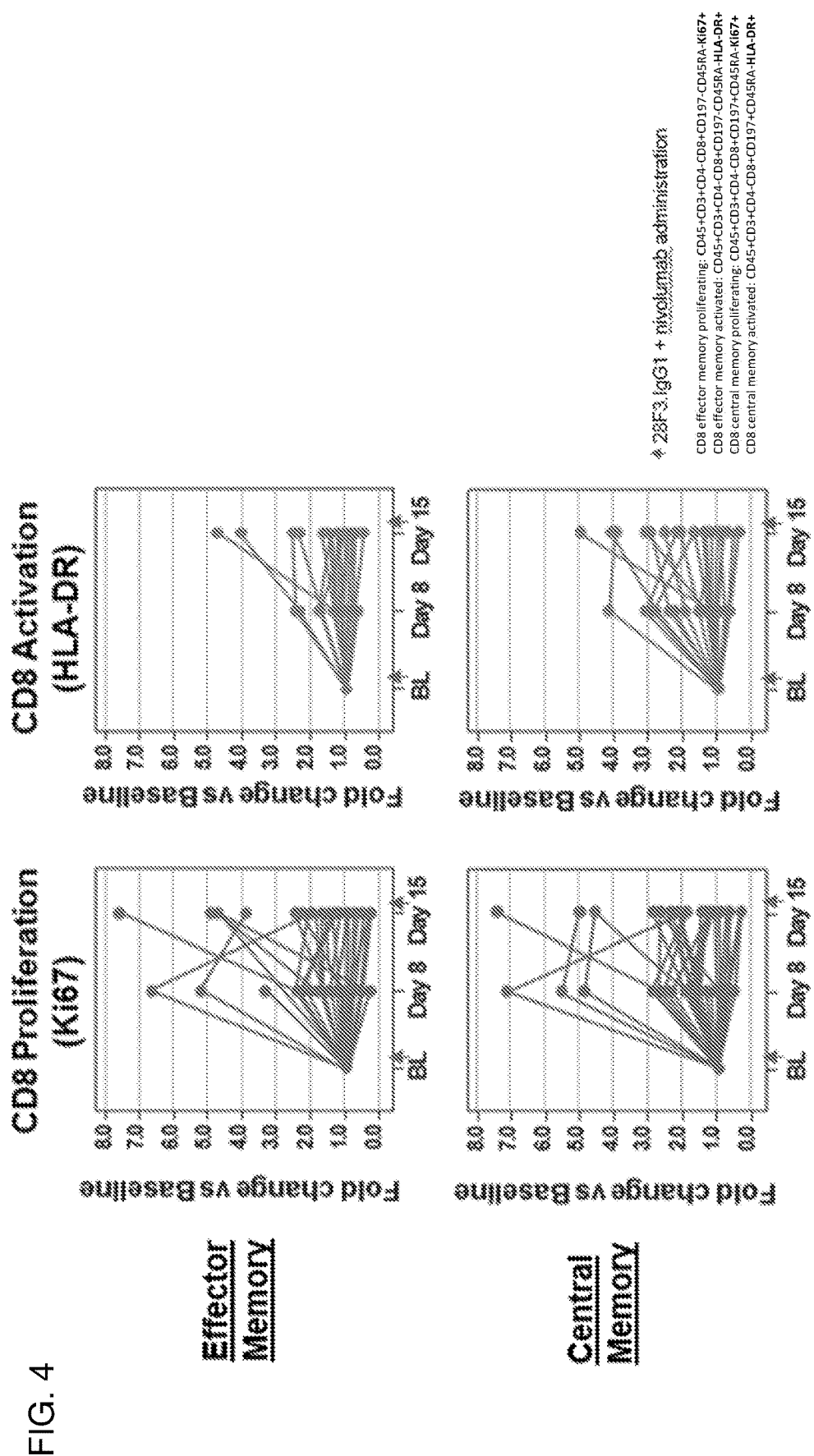
FIG. 4 shows that GITR Ab+nivolumab increases proliferation and activation of CD8 memory cells. The fold change over baseline of proliferation (measured with Ki67 marker) or activation (measured with HLA-DR marker) of effector memory CD8 cells is shown. The time of administration of the GITR Ab and nivolumab is shown with arrows.

Immunophenotyping of expansion phase patients shows increased proliferation and activation of CD8 effector memory cells and central memory cells (see FIG. 4). Transient increases were observed between day 8 and pre-dose on day 15. Similar results were observed with CD4 cells.

For flow cytometric analysis, blood samples were collected by direct vein puncture and collected in Streck Cytochex BCT tubes. Collection of the blood in these tubes allows the samples to be accurately analyzed up to 72 hour post blood collection. An aliquot was taken for TBNK (BD biosciences) analysis for downstream calculation of absolute counts of discreet cell populations. The remainder of the sample was subjected to lysing of the red blood cells using the standard BD pharmlyse procedure. The cells were then stained using fluorescently labeled antibodies specific for surface antigens CD45-ApC-H7 (2D1, BD biosciences), CD3-AF700 (SK7, Biolegend), CD4-BV510 (OKT4, Biolegend), CD8a-BV605 (RPA-T8, BD biosciences), CD27-AF647 (0323, Biolegend), CD45RA-BB515 (HI100, BD biosciences), CD197-BV421 (G043H7, Biolegend), HLA-DR-BV650 (G46-6, BD biosciences), PD-1-PE (MIH4, eBiosciences), CD38-PE Dazzle 594 (HB7, Biolegend), and CD152-PE-Cy7 (BNI3, BD biosciences). After surface staining, the samples were fixed and permeabilized using the standard protocol for BD biosciences Cytofix/Cytoperm reagent. The presence of Ki67 was measured using a specific anti-Ki67 antibody labeled with PerCP5.5 (B56, BD biosciences). The samples were then acquired on a Beckman Coulter Cytoflex S flow cytometer, and the resulting data was analyzed using FlowJo software (TreeStar). Antibodies used are set forth in the following table:

TABLE 11

| Antigen | Clone | Label | Cat # | Supplier |
|---------|-------|-------|-------|----------|
| CD45RA | HI100 | BB515 | 564552 | BD Biosciences |
| Ki-67 | B56 | PerCP5.5 | 561284 | BD Biosciences |
| CD197 | GO43H7 | BV421 | 353208 | Biolegend |
| CD4 | OKT4 | BV510 | 300546 | Biolegend |
| CD8a | RPA-T8 | BV605 | 563821 | BD Biosciences |
| HLA-DR | G46-6 | BV650 | 563965 | BD Biosciences |
| CD27 | O323 | AF647 | 302812 | Biolegend |
| CD3 | SK7 | AF700 | 344822 | Biolegend |
| CD45 | 2D1 | APC-H7 | 560178 | BD Biosciences |
| PD1 | MIH4 | PE | 12-9969-42 | eBiosciences |
| CD38 | HB7 | PE Dazzle 594 (TR) | 331226 | Biolegend |
| CD152 | BNI3 | PE-Cy7 | 560651 | BD Biosciences |

The following markers were used to quantify the different types of cells:

CD8 Effector memory: CD45+CD3+CD4-CD8+CD197-CD45RA−

CD8 effector memory activated: CD45+CD3+CD4-CD8+CD197-CD45RA-HLA-DR+

CD8 effector memory proliferating: CD45+CD3+CD4-CD8+CD197-CD45RA-Ki67+

CD8 Central memory: CD45+CD3+CD4-CD8+CD197+CD45RA−

CD8 central memory activated: CD45+CD3+CD4-CD8+ CD197+CD45RA-HLA-DR+

CD8 central memory proliferating: CD45+CD3+CD4-CD8+CD197+CD45RA-Ki67+

CD4 Effector memory: CD45+CD3+CD4+CD8-CD197-CD45RA-

CD4 Effector memory Activated: CD45+CD3+CD4+CD8-CD197-CD45RA-HLA-DR+

CD4 Effector memory Proliferating: CD45+CD3+CD4+CD8-CD197-CD45RA-Ki67+

CD4 Central memory: CD45+CD3+CD4+CD8-CD197+CD45RA-

CD4 Central memory Activated: CD45+CD3+CD4+CD8-CD197+CD45RA-HLA-DR+

CD4 Central memory Proliferating: CD45+CD3+CD4+CD8-CD197+CD45RA-Ki67+

Figure 5:
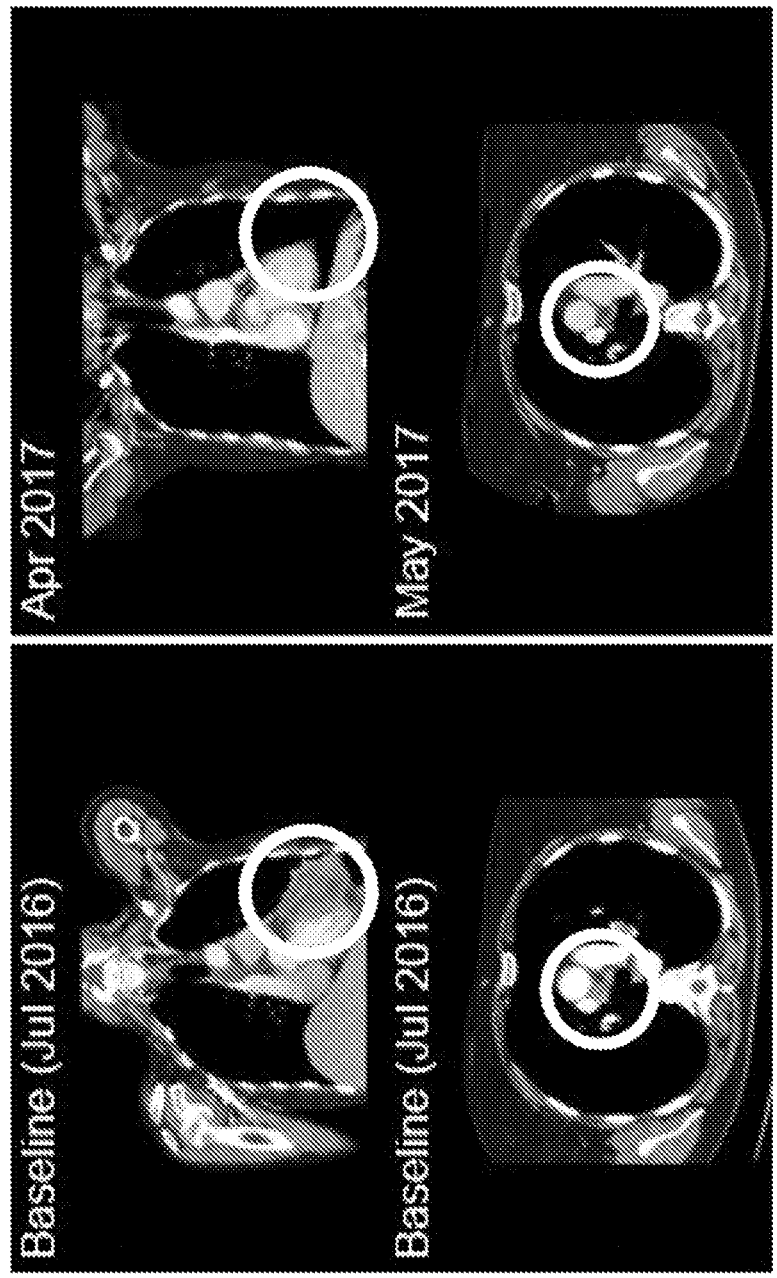
FIG. 5 shows cross sections of tumors in a patient with cervical cancer, at baseline (before treatment) and during treatment ("April 2017" and "May 2017") with a combination of 240 mg 28F3.IgG1 and 240 mg nivolumab. The changes in tumor size are shown with a circle.

Example 9: Response in a Tumor Type Known to Have High GITR Expression: Response to 28F3.IgG1+Nivolumab in a Patient with Cervical Cancer Cervical cancer has been associated with high GITR expression (Padovani C T J et al. *Rev Soc Bras Med Trop.* 2013; 46:288-292. 2 and Visser J et al. *Clin Exp Immunol.* 2007; 150:199-209). A 44 year old patient with metastatic cervical cancer who had 3 prior lines of therapy (chemotherapy±VEGF inhibitor) was treated with a combination of GITR Ab at 240 mg and nivolumab at 240 mg. About 9 months later, the patient showed a partial response, with a best change in tumor burden of −62% (FIG. 5). The duration of response at data cutoff was 8 weeks, and the response is still ongoing.

Figure 6:
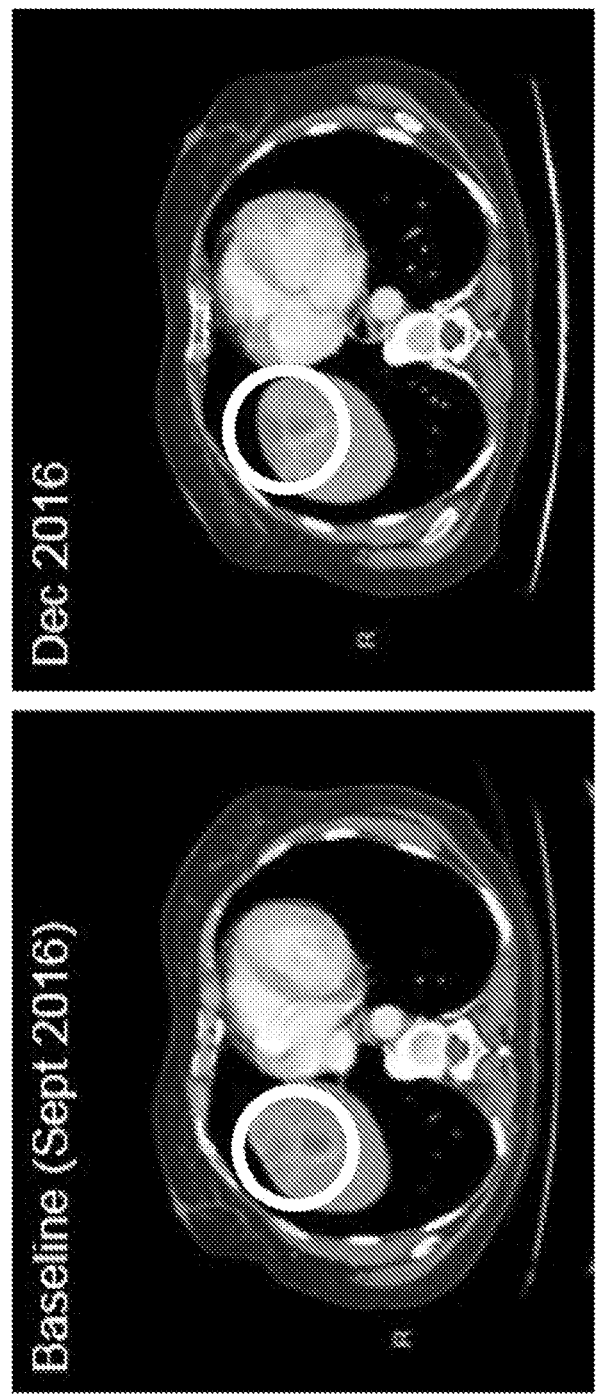
FIG. 6 shows cross sections of tumors in a patient with adenocarcinoma of the ampulla of Vater, at baseline (before treatment) and during treatment ("December 2017") with a combination of 240 mg 28F3.IgG1 and 240 mg nivolumab. The changes in tumor size are shown with a circle.

Example 10: Response in a Tumor Type Not Typically JO Responsive: 28F3.IgG1+Nivolumab in a Patient with Adenocarcinoma of the Ampulla of Vater A 69 year old patient with adenocarcinoma of the ampulla of Vater who had 3 prior lines of chemotherapy was treated with a combination of GITR Ab at 240 mg and nivolumab at 240 mg. A partial response was observed, with a best change in tumor burden of −38% (FIG. 6). The duration of response at data cutoff was 16 weeks; and the response is still ongoing.

Figure 7:
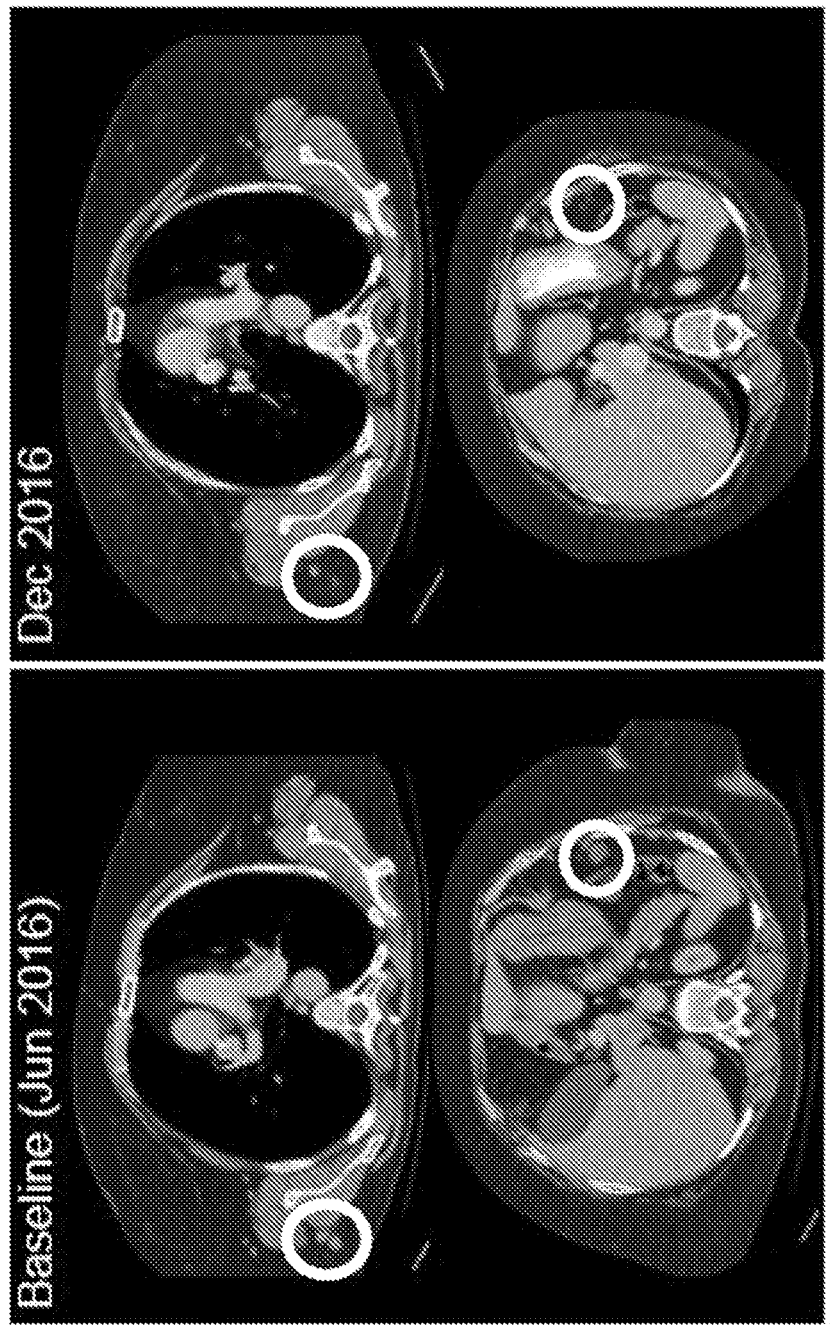
FIG. 7 shows cross sections of tumors in a patient with melanoma after progression on anti-PD-1 therapy, at baseline (before treatment) and during treatment ("December 2017") with a combination of 100 mg 28F3.IgG1 and 240 mg nivolumab. The changes in tumor size are shown with a circle.

Example 11: Response After Progression on Anti-PD-1 Therapy: 28F3.IgG1+Nivolumab in a Patient with Melanoma A 59 year old patient with metastatic melanoma who had 3 prior lines of therapy (BRAF inhibitor, PD-1 inhibitor [pembrolizumab for 3 months (February to May 2014); best response was progressive disease], and BRAF+MEK inhibitor) was treated with a combination of GITR Ab at 100 mg and nivolumab at 240 mg. A partial response was observed, with a best change in tumor burden of −41% (FIG. 7). The duration of response at data cutoff was 24 weeks; and the response is still ongoing.

Figure 8:
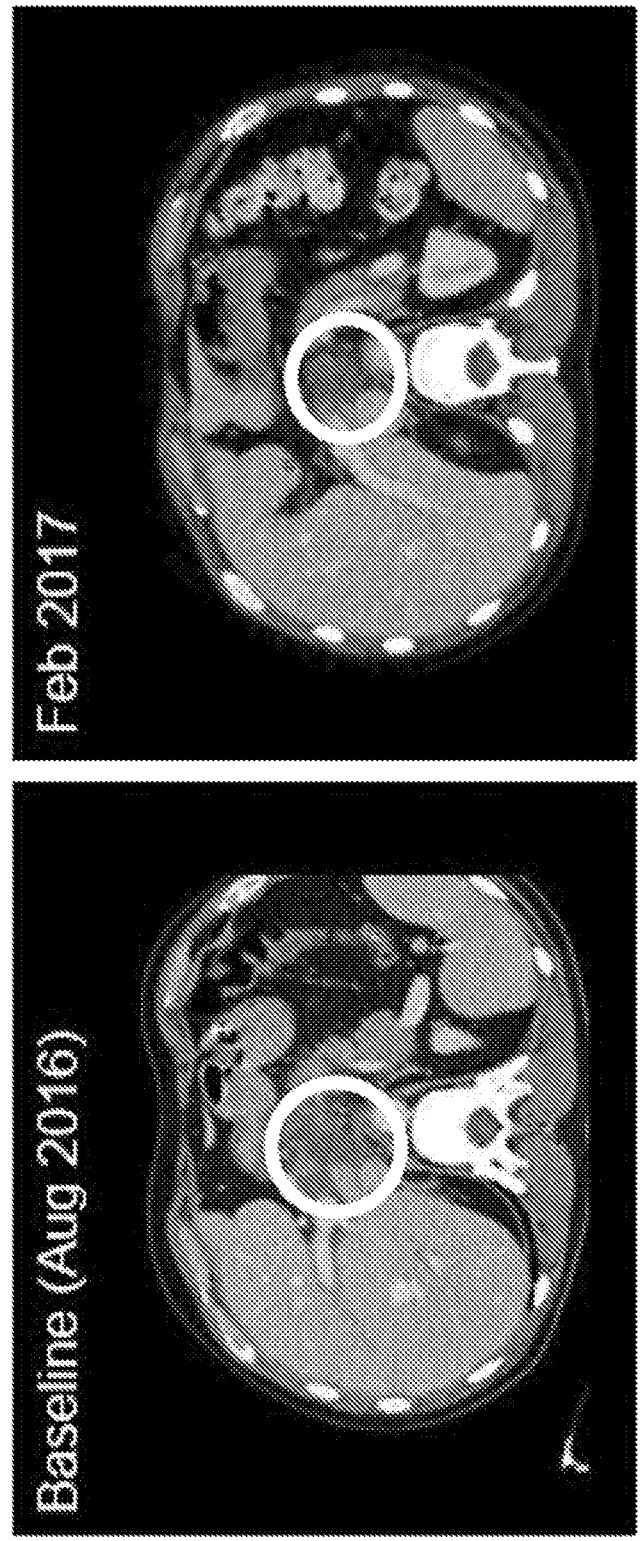
FIG. 8 shows cross sections of tumors in a patient with nasopharyngeal cancer after progression on anti-PD-1 therapy, at baseline (before treatment) and during treatment ("February 2017") with a combination of 240 mg 28F3.IgG1 and 240 mg nivolumab. The changes in tumor size are shown with a circle.

Example 12: Response After Progression on Anti-PD-1 Therapy: 28F3.IgG1+Nivolumab in a Patient With Nasopharyngeal Cancer A 32 year old patient with nasopharyngeal cancer who had 3 prior lines of therapy (chemotherapy, PD-1 inhibitor [pembrolizumab for 6 months (July 2014 to January 2015); best response was partial response, with subsequent progression], FGFR+PI3K inhibitor) was treated with a combination of GITR Ab at 240 mg and nivolumab at 240 mg. A partial response was observed, with a best change in tumor burden of −43% (FIG. 8). The duration of response at data cutoff was 17 weeks; and the response is still ongoing.

Thus, based at least on the results described in Examples 10 and 11, patients who progressed on/after prior anti-PD1 therapy can be treated with a combination of an anti-GITR antibody and an anti-PD-1 or PD-L1 antagonist.

Thus, the Examples show a first clinical report of an anti-GITR mAb+PD-1 inhibitor. The combination treatment demonstrated:

Linear PK with dose-related increase in exposure and low incidence of immunogenicity;

Well-tolerated safety profile consistent with that of nivolumab monotherapy; and Biologic activity with increased proliferation of NK and CD8 cells in peripheral blood and increased proliferation and activation of effector and central memory cells.

In addition, clinical responses were observed with 28F3.IgG1+nivolumab at biologically active doses and including patients who progressed on or after prior anti-PD1 therapy.

Example 13. Model-Based PK/PD Integration for First-in-Human Starting Dose Selection This Example describes how the first in human (FIH) starting dose for 28F3.IgG1 used in the clinical trial described in the previous Examples was determined.

It is important to select a FIH starting dose of protein therapeutics for cancer immunotherapy, and this is particularly challenging for a cancer immunotherapy agonist, e.g., a GITR agonist. Immune-mediated adverse effects (irAEs) is one of the key challenges in early development of cancer immunotherapeutics. irAEs are mostly on-target toxicities due to exaggerated pharmacology. FIH starting dose selection has evolved from mostly toxicology-based approach to an integrated pharmacology-based method. The starting dose selection for cancer patients is aimed to balance the safety and efficacy in FIH studies. PK/PD modeling plays an important role in nonclinical PK and pharmacology data integration.

Figure 9:
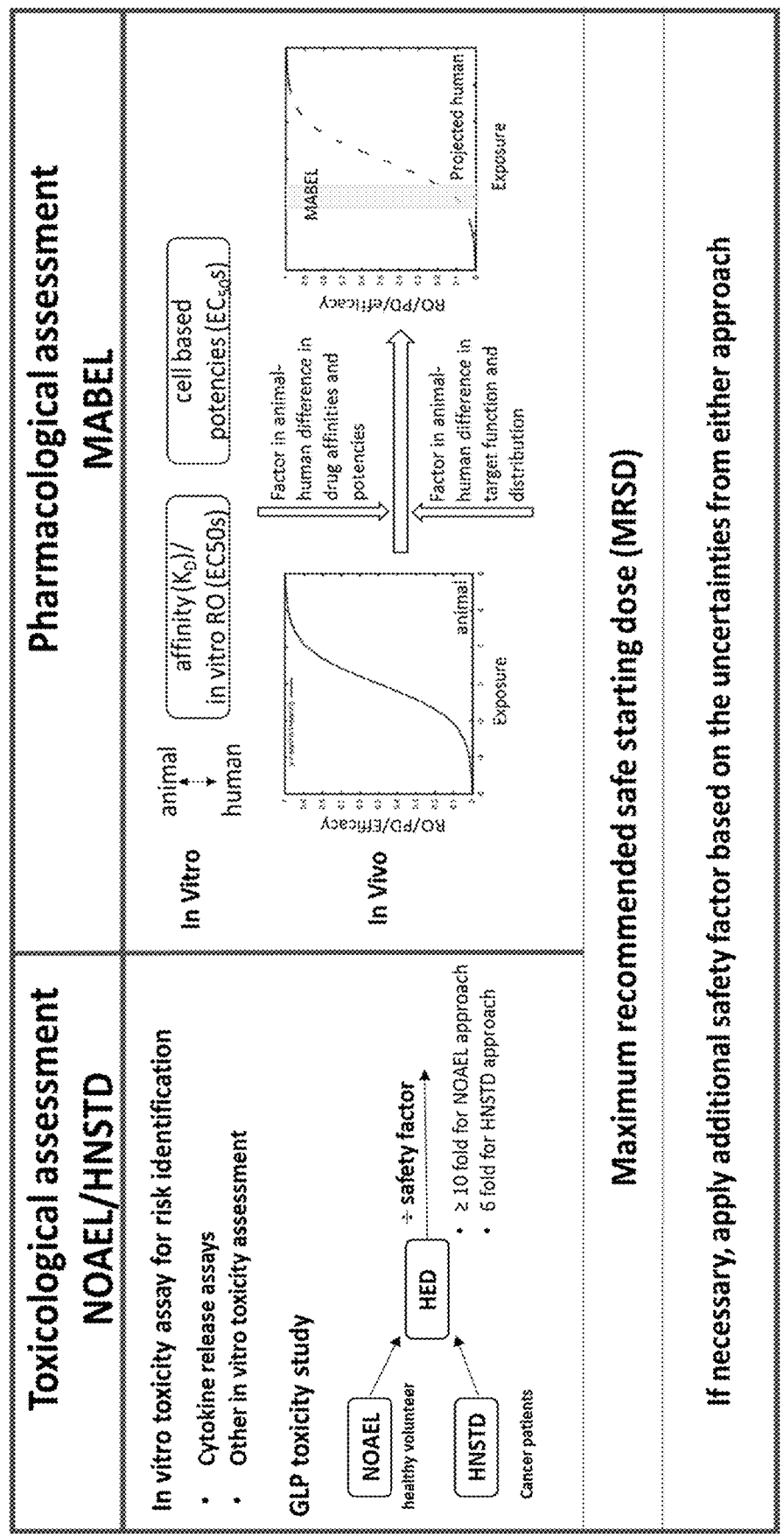
FIG. 9 is a schematic of approaches for FIH safe starting dose selection for novel immunomodulatory protein therapeutics.

Approaches for FIH safe starting dose selection for novel immunomodulatory protein therapeutics is shown in FIG. 9.

Figure 10:
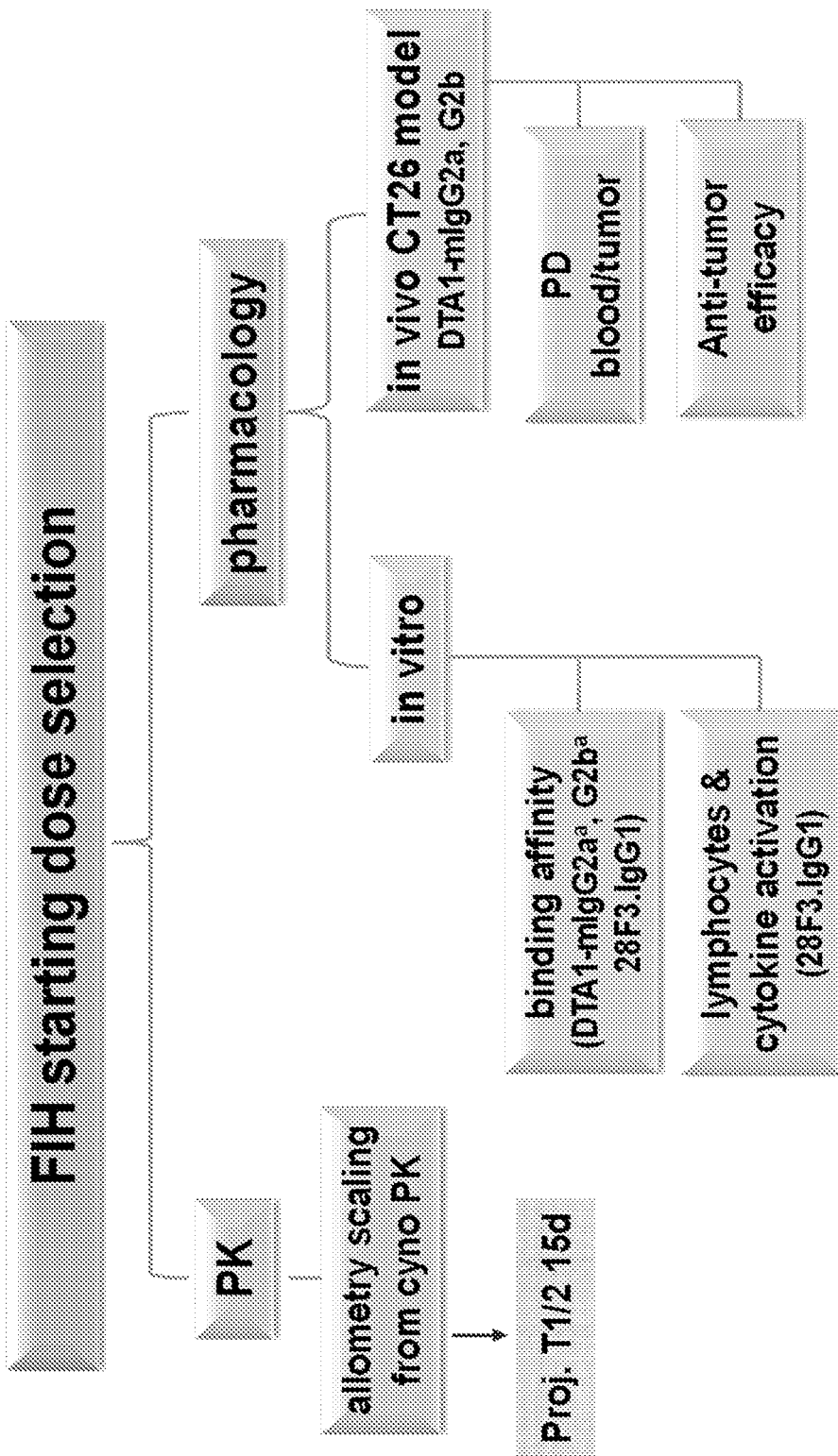
FIG. 10 is a schematic of the first-in-human dose selection strategy for 28F3.IgG1.
Figure 11:
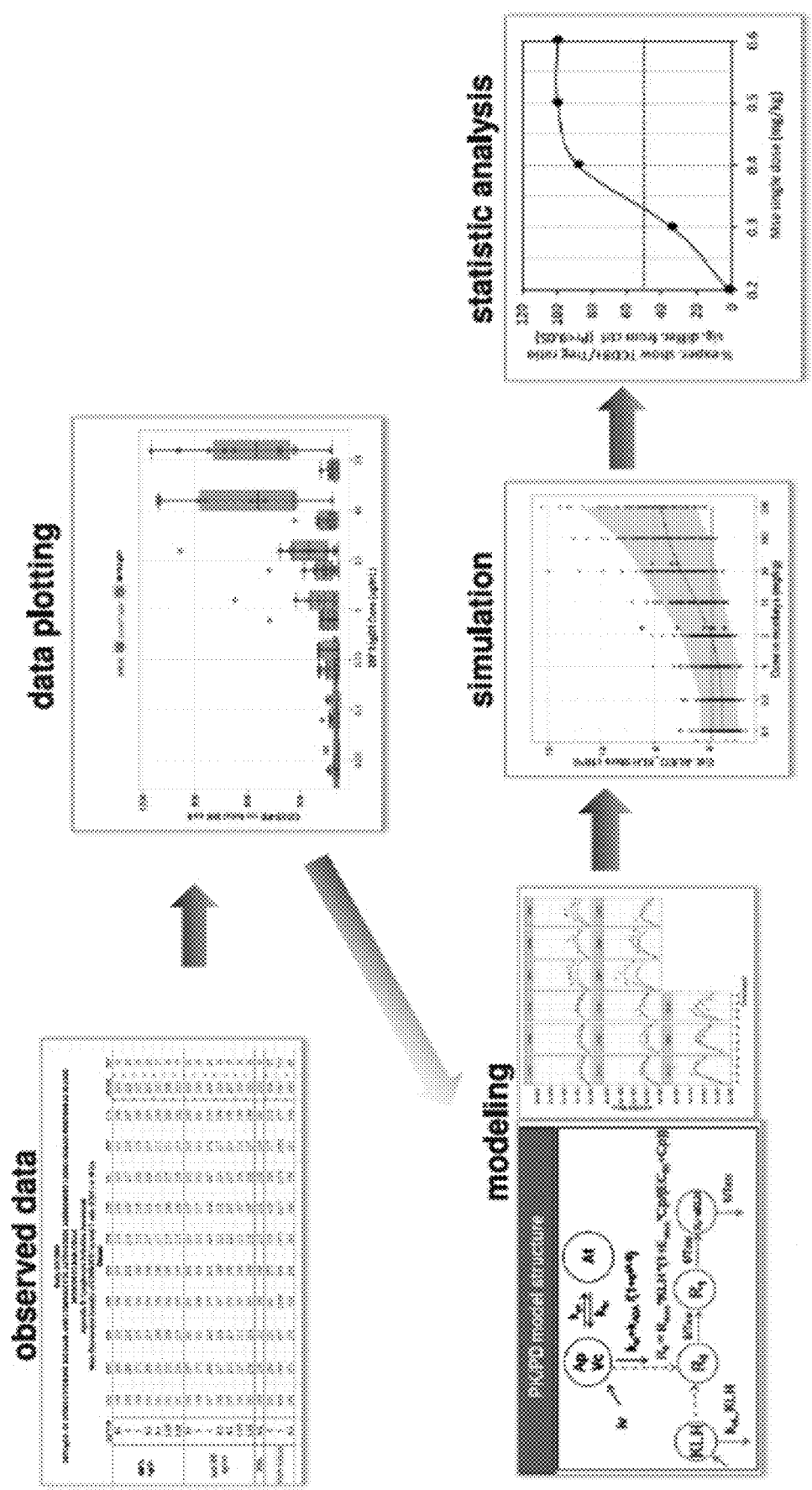
FIG. 11 is a schematic of the data analysis method for first-in-human dose selection.

28F3.IgG1 is a fully human agonist antibody that increases Teff survival and reduces Treg-mediated suppression. FcγR mediated ADCC activity leads to preferential depletion of intratumoral GITR high expression Tregs. A minimum anticipated biological effect level (MABEL) approach was employed for selecting FIH starting dose due to the agonistic mechanism on a novel target with unknown clinical safety information. A diagram of the 28F3.IgG1 FIH starting dose selection is provided in FIG. 10. DTA-mIgG2a and G2b are anti-mGITR surrogate antibodies with either mIgG2a or mIgG2b Fc. The data analysis method is shown in FIG. 11. The criteria of MABEL were the following:

In vitro activities/PD responses: to have >50% chance to be significantly different (P<0.05) from the control group.

Anti-tumor efficacy: 20% of the maximum efficacy

Table 12 shows the in vitro potencies of 28F3.IgG1 and its mouse surrogates (DTA1-mIgG2a and G2b). The affinities of all three antibodies for CD4+ T cells and CD8+ T cells were similar.

TABLE 12

| | In vitro binding EC50 (nM) on activated T cells | | |
|---|---|---|---|
| | 28F3.IgG1 | DTA1-mIgG2a | DTA1-mIgG2b |
| CD4+ T cells | 0.37 (human) | 0.14 (mouse) | 0.33 (mouse) |
| CD8+ T cells | 0.44 (human) | 0.17 (mouse) | 0.33 (mouse |

Figure 12:
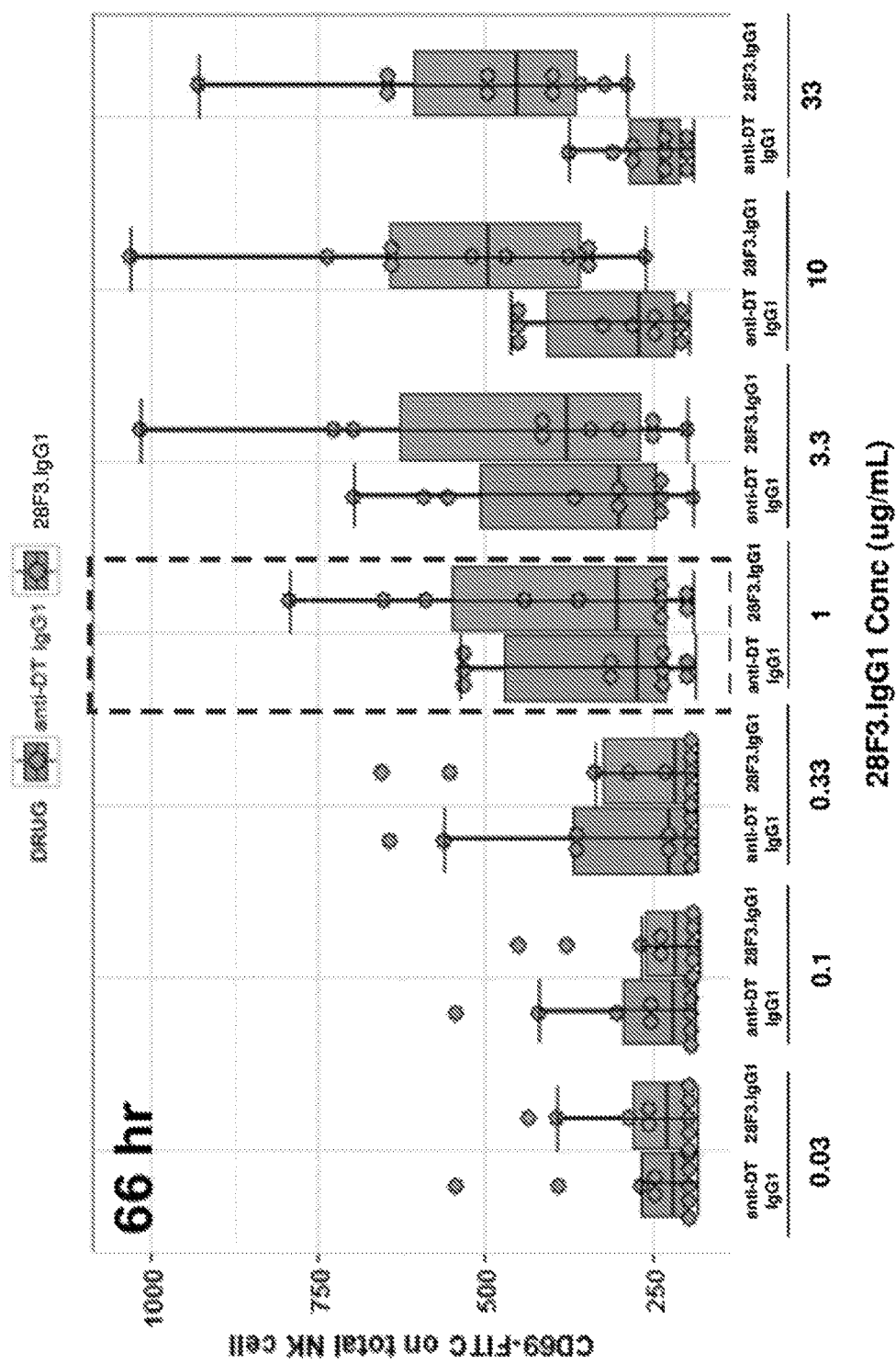
FIG. 12 is a graph showing NK cell activation at the indicated concentrations of 28F3.IgG1.

The effects of 28F3.IgG1 on in vitro cytokine release and lymphocyte activation in human whole blood PBMCs was determined. As shown in FIG. 12, there was:

no cytokine release or increased expression of activation markers on human T or B cells;

NK cell activation (high CD69+ and CD25+), consistent with constitutive low level GITR expression on NK cells; and NK cell activation with a minimum increase at 1 μg/mL.

Figure 13:
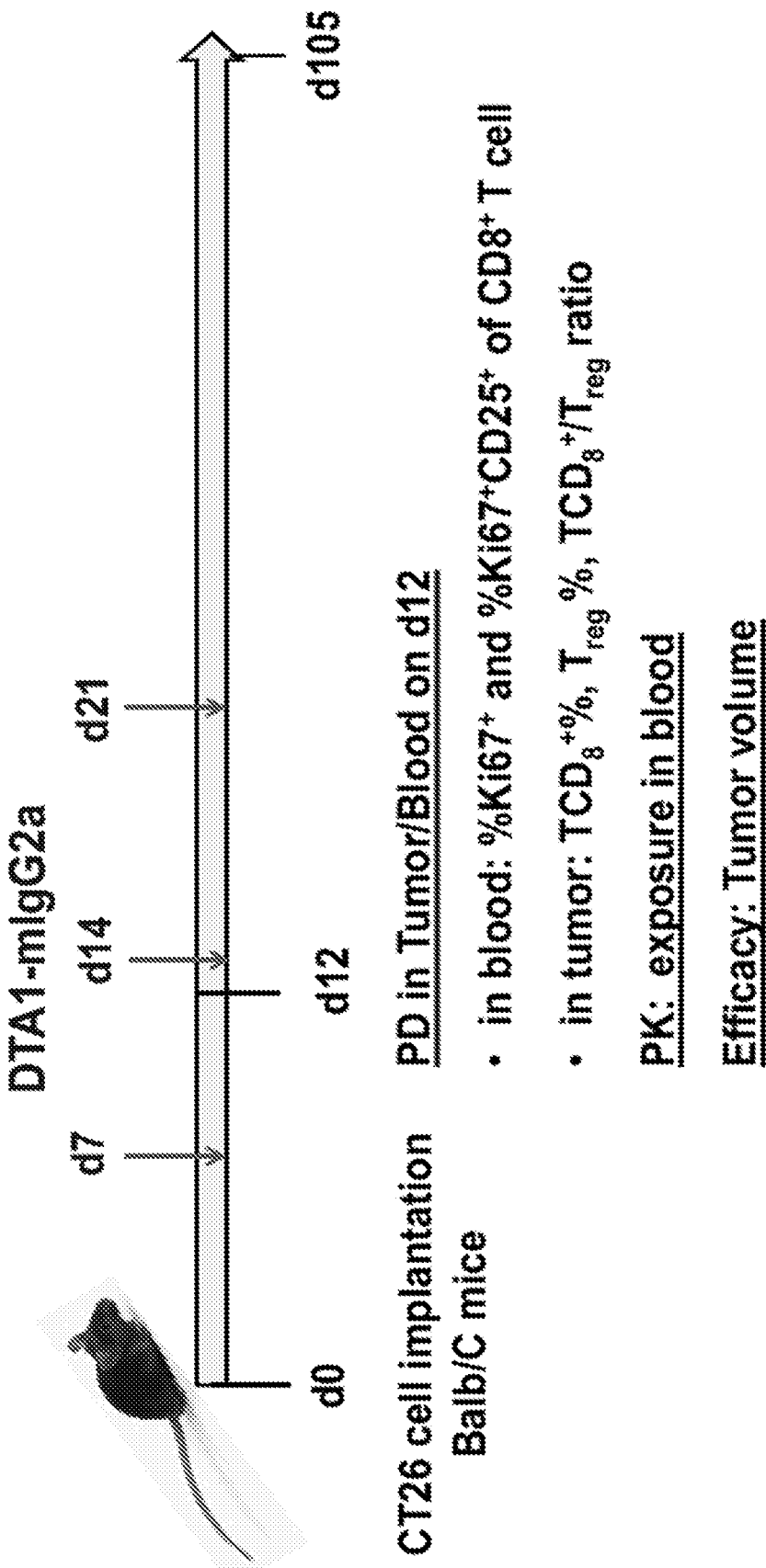
FIG. 13 is a schematic of the dosing schedule of DTA1-mIgG2a in the CT26 mouse tumor model.
Figure 14:
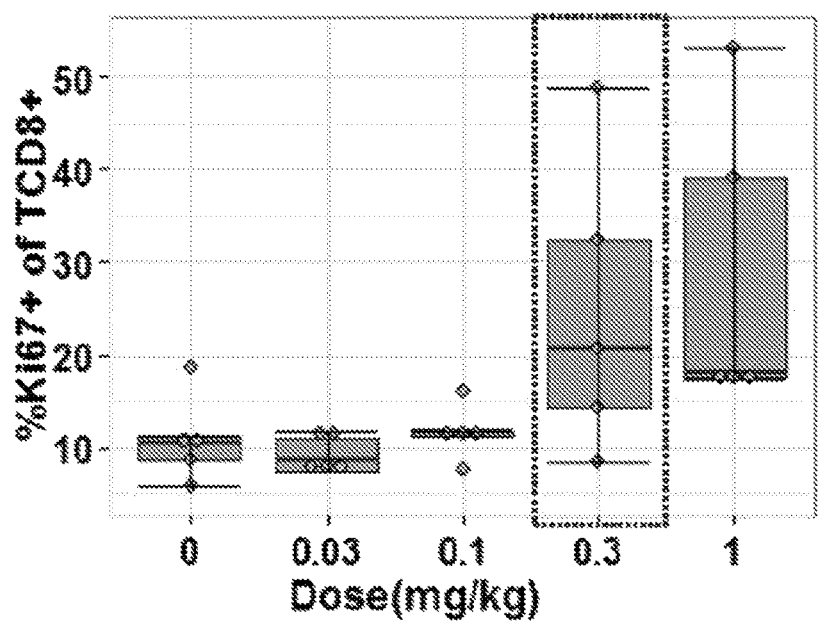
Figure 14:
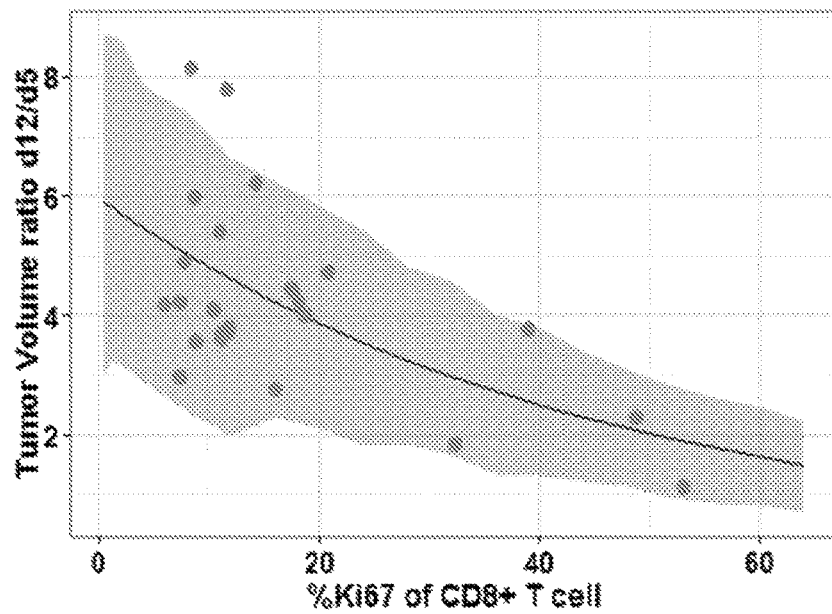
Figure 15:
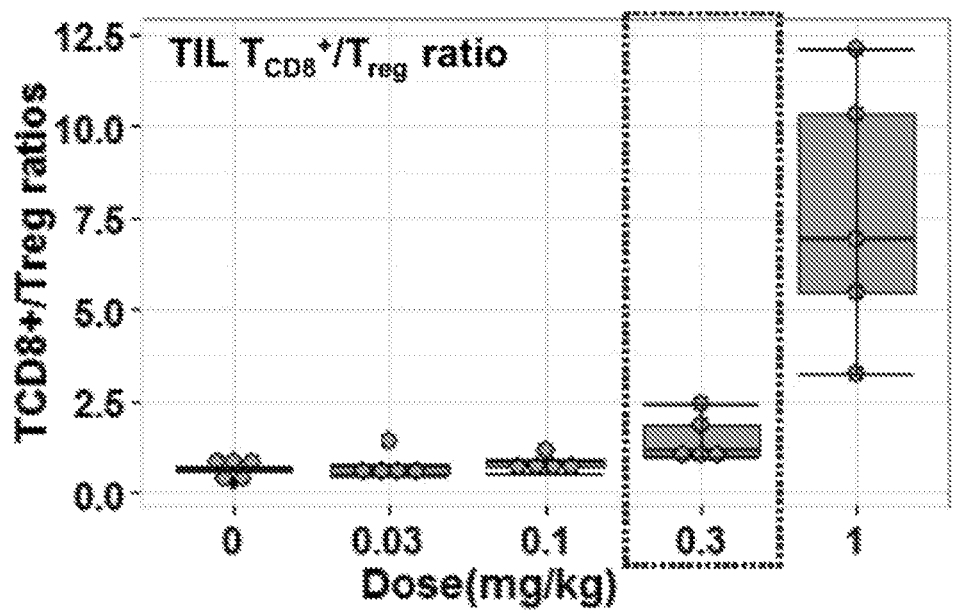
Figure 15:
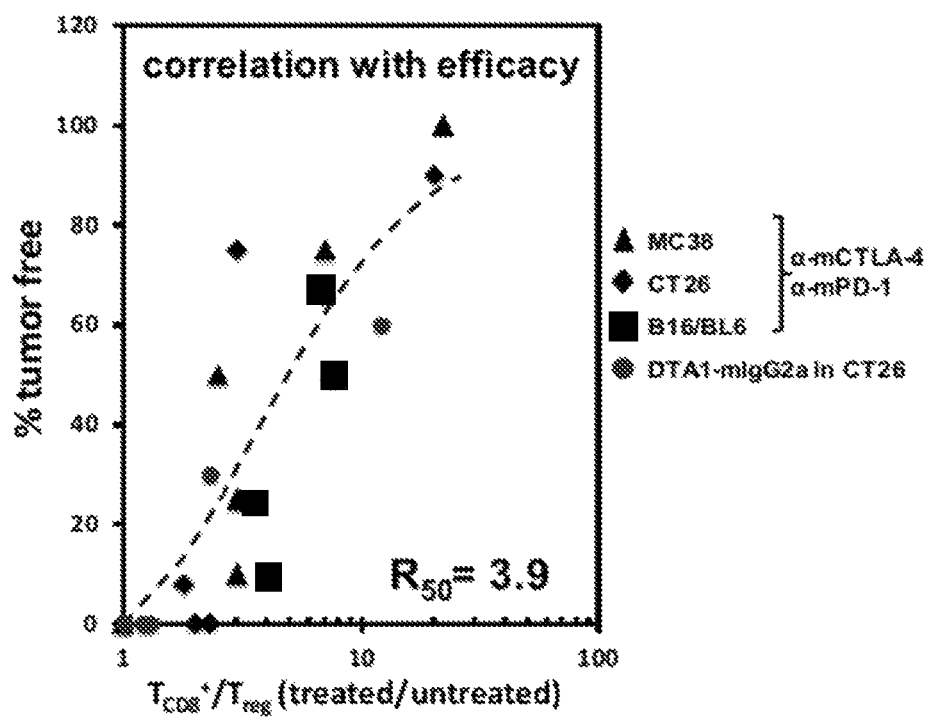

In vivo efficacy of the mouse surrogate antibody DTA1-mIgG2a in a syngeneic mouse CT26 tumor model (CT26 cell implantation into Balb/C mice) was determined. The dosing schedule is shown in FIG. 13, with antibody being dosed on days 7, 14, and 21 after cell implantation. PD was determined in tumor (% CD8+ T cells, % Tregs, CD8+ T cell/Treg ratio) and blood (% Ki67 and % Ki67+CD25+ among CD8+ T cells) on day 12. As shown in FIG. 14, a dose between 0.3-1 mg/kg achieved minimum increases in proliferating CD8+ T cells in blood. In tumors, a similar minimum increase in CD8+ T cell/Treg ratio was observed at 0.3-1 mg/kg, similar to that seen in blood (FIG. 15).

Figure 16:
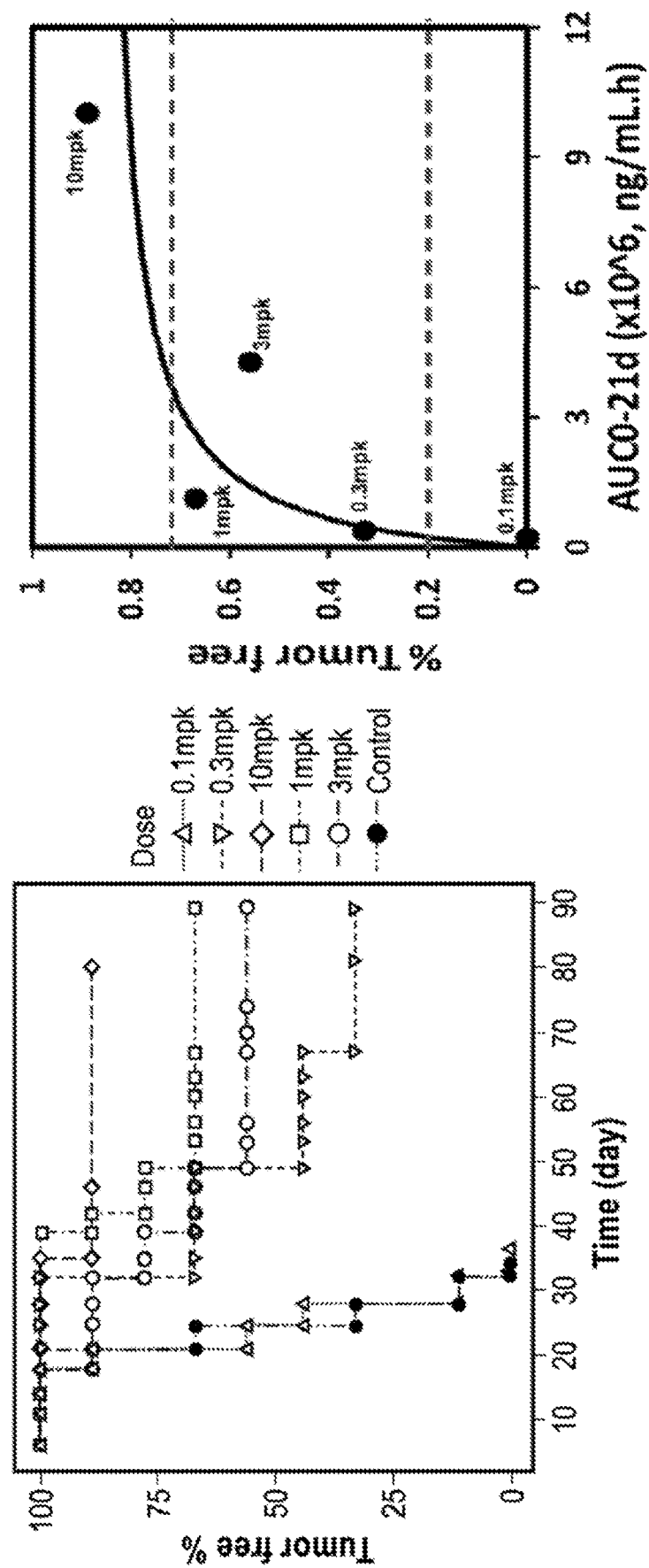

With respect to anti-tumor efficacy, the minimum efficacy was observed at 0.2 mg/kg with DTA1-mIgG2a. The minimum efficacy observed for DTA1-mIgG2b was at 0.6 mg/kg. As shown in FIG. 16, exposure of the antibody to achieve 20% survival was equivalent to the exposure at a single 0.2 mg/kg dose.

The data discussed above were used to project the MABEL dose of 28F3.IgG1. As shown in Table 13, the projected dose was determined to be 2.4-13.6 mg flat dose, or 0.03-0.17 mg/kg of the antibody.

TABLE 13

| In vitro studies | 28F3.IgG1 | | 28F3.IgG1 MABEL in humans |
|---|---|---|---|
| NK cell CD25 and CD69 activation biomarker | 1 μg/mL | | 3.2 mg (0.04 mg/kg) |
| In vivo CT26 mouse model | DTA1-mIgG2a | DTA1-mIgG2b | |
| Blood % Ki67+ of CD8+ T cells | 0.3-1 mg/kg | 0.3-1 mg/kg | 2.4-13.6 mg (0.03-0.17 mg/kg) |
| Tumor infiltrating lymphocytes CD8+ T cell/Treg ratio | 0.3 mg/kg | 0.3-1 mg/kg | |
| Antitumor efficacy | 0.2 mg/kg | 0.6 mg/kg | |

Figure 17:
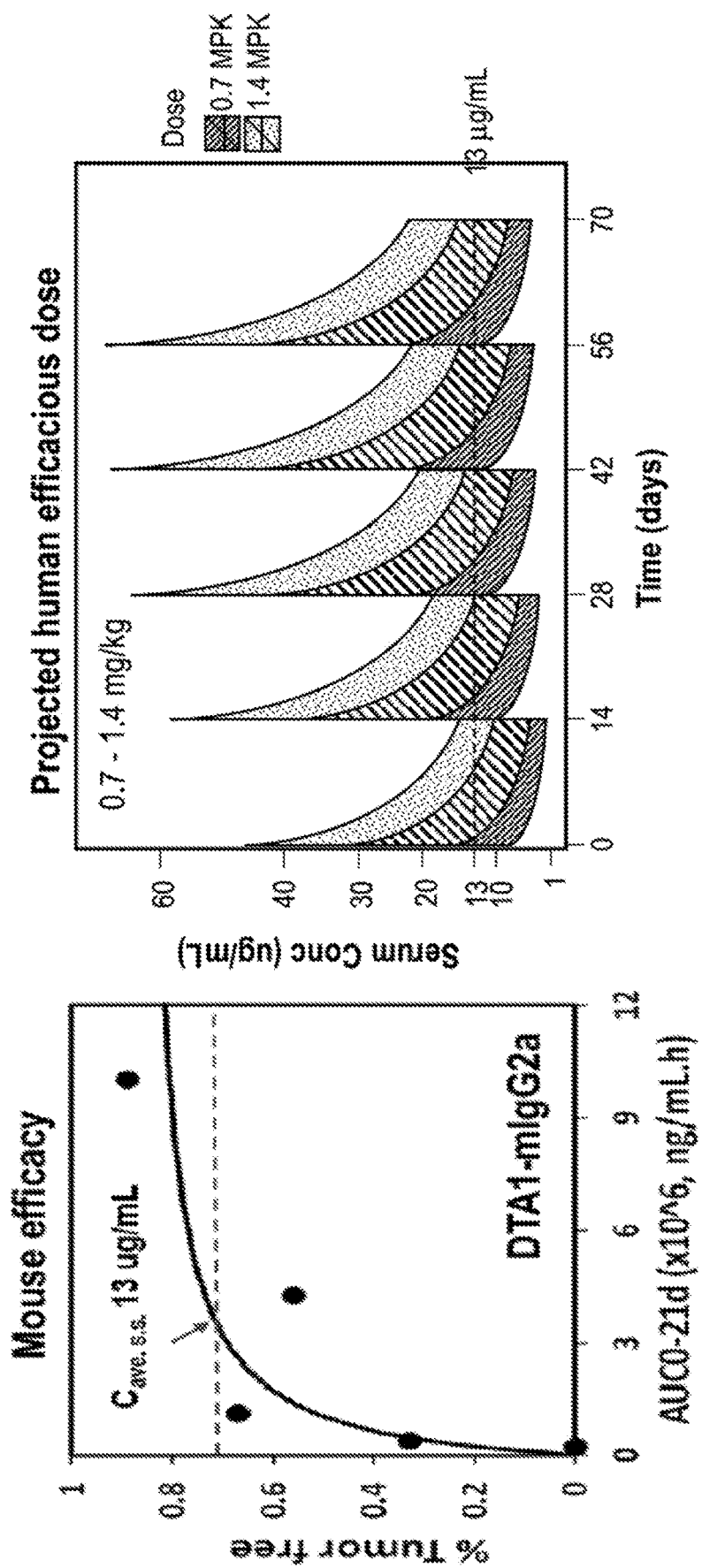
FIG. 17 is a graph showing projections of the human efficacious dose based on mouse efficacy data (tumor-free mice).

The human efficacious dose was determined by projections based on mouse efficacy data, as shown in FIG. 17. The projected human efficacious dose was determined to be 0.7-1.4 mg/kg iv at Q2W, targeting an average steady state concentration (Css_ave) of 13 μg/mL. Some uncertainties in the model include: the relevance of the mouse tumor model; mouse surrogate antibody was used in the study; and mIgG2a versus huIgG1 may have different depletion potencies.

In conclusion, a Model-based nonclinical PK/PD data integration facilitates early clinical development. A phase I starting dose of 10 mg (within 2.4-13.6 mg MABEL dose range) was selected to balance pharmacologic activity and safety. This dose was about 100-fold lower than the maximum recommended starting dose (992 mg or 12 mg/kg) projected from IND toxicity studies in monkeys, and about 10-fold lower than the projected human efficacious dose (0.7-1.4 mg/kg).

As further described herein, a Phase 1 dose escalation of 10, 30, 100, 240, and 800 mg was well tolerated; 240 mg Css_trough exceeds concentration of 13 μg/mL; in combinations with nivolumab at 240 mg for each Q2W, an increase in proliferating NK and CD8 cells was observed in peripheral blood.

Equivalents:

Those skilled in the art will recognize, or be able to ascertain using no more than routine experimentation, many equivalents of the specific embodiments disclosed herein. Such equivalents are intended to be encompassed by the following claims.

SEQUENCE LISTING (407 sequences)

SEQ ID NO: 1 - protein, 241 aa, Homo sapiens
  misc_feature (1)..(241): Human GITR isoform 1
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 2 - protein, 255 aa, Homo sapiens
  misc_feature (1)..(255): Human GITR isoform 2
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 3 - protein, 234 aa, Homo sapiens
  misc_feature (1)..(234): Human GITR isoform 3
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 4 - protein, 137 aa, Homo sapiens
  misc_feature (1)..(137): Human GITR (mature)
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEP

SEQ ID NO: 5 - protein, 235 aa, Macaca fascicularis
  misc_feature (1)..(235): Cynomolgus GITR
MCASGTLCCLALLCAASLGQRPTGGPGCGPGRLLLGTGKDARCCRVHPTRCCRDYQGEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIILLAVAACVLLLTSAQLGLHIWQLRSQPTGPRETQLLLEVPPSTEDASSCQFPEEERGERLAEEKGRLGDLWV

SEQ ID NO: 6 - protein, 199 aa, Homo sapiens
  misc_feature (1)..(199): Human GITR-L
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 7 - protein, 329 aa, Homo sapiens
  misc_feature (1)..(329): Human IgG1 constant domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8 - protein, 329 aa, Homo sapiens
  misc_feature (1)..(329): Human IgG1 constant domain (allotypic variant)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 9 - protein, 329 aa, Homo sapiens
  misc_feature (1)..(329): Human IgG1constant domain with L234A, L235E, and G237A mutations
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10 - protein, 329 aa, Homo sapiens
  misc_feature (1)..(329): Human IgG1constant domain with A330S and P331S mutations
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 11 - protein, 329 aa, Homo sapiens
  misc_feature (1)..(329): Human IgG1.1 constant domain (L234A, L235E, G237A, A330S, and P331S mutations)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - protein, 107 aa, Homo sapiens [sequence omitted]

SEQ ID NO: 13 - protein, 124 aa, Artificial Sequence
  Synthetic: 28F3 (VH)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS

SEQ ID NO: 14 - protein, 107 aa, Artificial Sequence
  Synthetic: 28F3 (VL)
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 15 - protein, 450 aa, Artificial Sequence
  Synthetic: 28F3 (full length wild-type heavy chain)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 16 - protein, 214 aa, Artificial Sequence
  Synthetic: 28F3 (full length wild-type light chain)
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 453 aa, Artificial Sequence
  Synthetic: 28F3.IgG1 (VH + IgG1)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 453 aa, Artificial Sequence
  Synthetic: 28F3.IgG1.1 (VH + IgG1.1)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 19 - protein, 214 aa, Artificial Sequence; identical to SEQ ID NO: 16
  Synthetic: 28F3.IgG1 (VL + CL)

SEQ ID NO: 20 - protein, 5 aa, Artificial Sequence
  Synthetic: 28F3 VH CDR1
SYGMH

SEQ ID NO: 21 - protein, 17 aa, Artificial Sequence
  Synthetic: 28F3 VH CDR2
VIWYEGSNKYYADSVKG

SEQ ID NO: 22 - protein, 15 aa, Artificial Sequence
  Synthetic: 28F3 VH CDR3
GGSMVRGDYYYGMDV

SEQ ID NO: 23 - protein, 11 aa, Artificial Sequence
  Synthetic: 28F3 VL CDR1
RASQGISSALA

SEQ ID NO: 24 - protein, 7 aa, Artificial Sequence
  Synthetic: 28F3 VL CDR2
DASSLES

SEQ ID NO: 25 - protein, 9 aa, Artificial Sequence
  Synthetic: 28F3 VL CDR3
QQFNSYPYT

SEQ ID NO: 26 - protein, 123 aa, Artificial Sequence
  Synthetic: 19D3 (VH)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSS

SEQ ID NO: 27 - protein, 107 aa, Artificial Sequence
  Synthetic: 19D3 (VL)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 28 - protein, 449 aa, Artificial Sequence
  Synthetic: 19D3 (full length wild-type heavy chain)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29 - protein, 214 aa, Artificial Sequence
  Synthetic: 19D3 (full length wild-type light chain)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 452 aa, Artificial Sequence
  Synthetic: 19D3.IgG1 (VH + IgG1)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 31 - protein, 452 aa, Artificial Sequence
  Synthetic: 19D3.IgG1.1 (VH + IgG1.1)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 32 - protein, 214 aa, Artificial Sequence; identical to SEQ ID NO: 29
  Synthetic: 19D3.IgG1 (VL + CL)

SEQ ID NO: 33 - protein, 5 aa, Artificial Sequence
  Synthetic: 19D3 VH CDR1
SYGFH

SEQ ID NO: 34 - protein, 17 aa, Artificial Sequence
  Synthetic: 19D3 VH CDR2
VIWYAGSNKFYADSVKG

SEQ ID NO: 35 - protein, 14 aa, Artificial Sequence
  Synthetic: 19D3 VH CDR3
GGQLDYYYYYVMDV

SEQ ID NO: 36 - protein, 11 aa, Artificial Sequence
  Synthetic: 19D3 VL CDR1
RASQGISSWLA

SEQ ID NO: 37 - protein, 7 aa, Artificial Sequence
  Synthetic: 19D3 VL CDR2
AASSLQS

SEQ ID NO: 38 - protein, 9 aa, Artificial Sequence
  Synthetic: 19D3 VL CDR3
QQYNSYPYT

SEQ ID NO: 39 - protein, 123 aa, Artificial Sequence
  Synthetic: 18E10 (VH)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSS

SEQ ID NO: 40 - protein, 107 aa, Artificial Sequence; identical to SEQ ID NO: 27
  Synthetic: 18E10 (VL)

SEQ ID NO: 41 - protein, 449 aa, Artificial Sequence
  Synthetic: 18E10 (full length wild-type heavy chain)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 42 - protein, 214 aa, Artificial Sequence; identical to SEQ ID NO: 29
  Synthetic: 18E10 (full length wild-type light chain)

SEQ ID NO: 43 - protein, 452 aa, Artificial Sequence
  Synthetic: 18E10.IgG1 (VH + IgG1)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 44 - protein, 452 aa, Artificial Sequence
  Synthetic: 18E10.IgG1.1 (VH + IgG1.1)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 45 - protein, 214 aa, Artificial Sequence; identical to SEQ ID NO: 29
  Synthetic: 18E10.IgG1 (VL + CL)

SEQ ID NO: 46 - protein, 5 aa, Artificial Sequence
  Synthetic: 18E10 VH CDR1
SYGMH

SEQ ID NO: 47 - protein, 17 aa, Artificial Sequence
  Synthetic: 18E10 VH CDR2
VIWYAGSNKYYADSVKG

SEQ ID NO: 48 - protein, 14 aa, Artificial Sequence
  Synthetic: 18E10 VH CDR3
GGRIAVAFYYSMDV

SEQ ID NO: 49 - protein, 11 aa, Artificial Sequence
  Synthetic: 18E10 VL CDR1
RASQGISSWLA

SEQ ID NO: 50 - protein, 7 aa, Artificial Sequence
  Synthetic: 18E10 VL CDR2
AASSLQS

SEQ ID NO: 51 - protein, 9 aa, Artificial Sequence
  Synthetic: 18E10 VL CDR3
QQYNSYPYT

SEQ ID NO: 52 - protein, 117 aa, Artificial Sequence
  Synthetic: 3C3 (VH)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSS

SEQ ID NO: 53 - protein, 107 aa, Artificial Sequence; identical to SEQ ID NO: 27
  Synthetic: 3C3 (VL1)

SEQ ID NO: 54 - protein, 106 aa, Artificial Sequence
  Synthetic: 3C3 (VL2)
EIVLTQSPATLSLSPGERATLSCRASQGVSSYLAWYQQKPGQAPRLLIYDASNRATGIPARFSGSGPGTDFTLTISSLEPEDFAVYYCQQRSNWHTFGQGTKLEIK

SEQ ID NO: 55 - protein, 447 aa, Artificial Sequence
  Synthetic: 3C3 (full length wild-type heavy chain)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 214 aa, Artificial Sequence; identical to SEQ ID NO: 29
  Synthetic: 3C3 L1 (full length wild-type light chain 1)

SEQ ID NO: 57 - protein, 213 aa, Artificial Sequence
  Synthetic: 3C3 L2 (full length wild-type light chain 2)
EIVLTQSPATLSLSPGERATLSCRASQGVSSYLAWYQQKPGQAPRLLIYDASNRATGIPARFSGSGPGTDFTLTISSLEPEDFAVYYCQQRSNWHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 446 aa, Artificial Sequence
  Synthetic: 3C3.IgG1 (VH + IgG1)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 59 - protein, 446 aa, Artificial Sequence
  Synthetic: 3C3.IgG1.1 (VH + IgG1.1)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 60 - protein, 214 aa, Artificial Sequence; identical to SEQ ID NO: 29
  Synthetic: 3C3.IgG1 (VL1 + CL)

SEQ ID NO: 61 - protein, 213 aa, Artificial Sequence; identical to SEQ ID NO: 57
  Synthetic: 3C3IgG1.2 (VL2 + CL)

SEQ ID NO: 62 - protein, 5 aa, Artificial Sequence
  Synthetic: 3C3 VH CDR1
GYYWT

SEQ ID NO: 63 - protein, 16 aa, Artificial Sequence
  Synthetic: 3C3 VH CDR2
KINHSGNTNYNPSLKS

SEQ ID NO: 64 - protein, 9 aa, Artificial Sequence
  Synthetic: 3C3 VH CDR3
LGAFDAFDI

SEQ ID NO: 65 - protein, 11 aa, Artificial Sequence
  Synthetic: 3C3 VL1 CDR1
RASQGISSWLA

SEQ ID NO: 66 - protein, 7 aa, Artificial Sequence
  Synthetic: 3C3 VL1 CDR2
AASSLQS

SEQ ID NO: 67 - protein, 9 aa, Artificial Sequence
  Synthetic: 3C3 VL1 CDR3
QQYNSYPYT

SEQ ID NO: 68 - protein, 11 aa, Artificial Sequence
  Synthetic: 3C3 VL2 CDR1
RASQGVSSYLA

SEQ ID NO: 69 - protein, 7 aa, Artificial Sequence
  Synthetic: 3C3 VL2 CDR2
DASNRAT

SEQ ID NO: 70 - protein, 8 aa, Artificial Sequence
  Synthetic: 3C3 VL2 CDR3
QQRSNWHT

SEQ ID NO: 71 - protein, 124 aa, Artificial Sequence
  Synthetic: 2G6 (VH)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSS

SEQ ID NO: 72 - protein, 107 aa, Artificial Sequence; identical to SEQ ID NO: 27
  Synthetic: 2G6 (VL)

SEQ ID NO: 73 - protein, 450 aa, Artificial Sequence
  Synthetic: 2G6 (full length wild-type heavy chain)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - protein, 214 aa, Artificial Sequence; identical to SEQ ID NO: 29
  Synthetic: 2G6 (full length wild-type light chain)

SEQ ID NO: 75 - protein, 453 aa, Artificial Sequence
  Synthetic: 2G6.IgG1 (VH + IgG1)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 76 - protein, 453 aa, Artificial Sequence
  Synthetic: 2G6.IgG1.1 (VH + IgG1.1)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 214 aa, Artificial Sequence; identical to SEQ ID NO: 29
  Synthetic: 2G6.IgG1 (VL + CL)

SEQ ID NO: 78 - protein, 5 aa, Artificial Sequence
  Synthetic: 2G6 VH CDR1
DYGMH

SEQ ID NO: 79 - protein, 17 aa, Artificial Sequence
  Synthetic: 2G6 VH CDR2
VIWYDGSNKFYVDSVKG

SEQ ID NO: 80 - protein, 15 aa, Artificial Sequence
  Synthetic: 2G6 VH CDR3
GGRLATGHFYYVMDV

SEQ ID NO: 81 - protein, 11 aa, Artificial Sequence
  Synthetic: 2G6 VL CDR1
RASQGISSWLA

SEQ ID NO: 82 - protein, 7 aa, Artificial Sequence
  Synthetic: 2G6 VL CDR2
AASSLQS

SEQ ID NO: 83 - protein, 9 aa, Artificial Sequence
  Synthetic: 2G6 VL CDR3
QQYNSYPYT

SEQ ID NO: 84 - protein, 124 aa, Artificial Sequence
  Synthetic: 8A6 (VH)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSS

SEQ ID NO: 85 - protein, 107 aa, Artificial Sequence
  Synthetic: 8A6 (VL)
AIQLTQSPSSLSASVGDRVTITCRASQGISSALAWYQQKPGKAPKFLIYDASSLESGVPSRFSGSGSGTDFTLTISSLQPEDFATYYCQQFNSYPYTFGQGTKLEIK

SEQ ID NO: 86 - protein, 450 aa, Artificial Sequence
  Synthetic: 8A6 (full length wild-type heavy chain)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 87 - protein, 214 aa, Artificial Sequence
  Synthetic: 8A6 (full length wild-type light chain)
AIQLTQSPSSLSASVGDRVTITCRASQGISSALAWYQQKPGKAPKFLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 453 aa, Artificial Sequence
  Synthetic: 8A6.IgG1 (VH + IgG1)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 89 - protein, 453 aa, Artificial Sequence
  Synthetic: 8A6.IgG1.1 (VH + IgG1.1)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 214 aa, Artificial Sequence; identical to SEQ ID NO: 87
  Synthetic: 8A6.IgG1 (VL + CL)

SEQ ID NO: 91 - protein, 5 aa, Artificial Sequence
  Synthetic: 8A6 VH CDR1
SYGMQ

SEQ ID NO: 92 - protein, 17 aa, Artificial Sequence
  Synthetic: 8A6 VH CDR2
VIWYEGSNKYYADSVKG

SEQ ID NO: 93 - protein, 15 aa, Artificial Sequence
  Synthetic: 8A6 VH CDR3
GGLMVRGLFYYGMDV

SEQ ID NO: 94 - protein, 11 aa, Artificial Sequence
  Synthetic: 8A6 VL CDR1
RASQGISSALA

SEQ ID NO: 95 - protein, 7 aa, Artificial Sequence
  Synthetic: 8A6 VL CDR2
DASSLES

SEQ ID NO: 96 - protein, 9 aa, Artificial Sequence
  Synthetic: 8A6 VL CDR3
QQFNSYPYT

SEQ ID NO: 97 - protein, 125 aa, Artificial Sequence
  Synthetic: 9G7 (VH)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSS

SEQ ID NO: 98 - protein, 108 aa, Artificial Sequence
  Synthetic: 9G7 (VL1)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 99 - protein, 108 aa, Artificial Sequence
  Synthetic: 9G7 (VL2)
EIVLTQSPGTLSLSPGERATLSCRASQSVTSSYLAWYQQKPGQAPRLLIYGASSRATGIPERFSGSGSGTDFTLTISRLEPEDFAVYYCQQYGSSPITFGQGTRLEIK

SEQ ID NO: 100 - protein, 452 aa, Artificial Sequence
  Synthetic: 9G7 (full length wild-type heavy chain)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 101 - protein, 215 aa, Artificial Sequence
  Synthetic: 9G7 L2 (full length wild-type light chain 2)
EIVLTQSPGTLSLSPGERATLSCRASQSVTSSYLAWYQQKPGQAPRLLIYGASSRATGIPERFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 454 aa, Artificial Sequence
  Synthetic: 9G7.IgG1 (VH + IgG1)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 454 aa, Artificial Sequence
  Synthetic: 9G7.IgG1.1 (VH + IgG1.1)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 215 aa, Artificial Sequence
  Synthetic: 9G7.IgG1 (VL1 + CL)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 215 aa, Artificial Sequence; identical to SEQ ID NO: 101
  Synthetic: 9G7.IgG1.2 (VL2 + CL)

SEQ ID NO: 106 - protein, 5 aa, Artificial Sequence
  Synthetic: 9G7 VH CDR1
TVWMS

SEQ ID NO: 107 - protein, 19 aa, Artificial Sequence
  Synthetic: 9G7 VH CDR2
RIKSKTDGGTTDYAAPVKG

SEQ ID NO: 108 - protein, 14 aa, Artificial Sequence
  Synthetic: 9G7 VH CDR3
GQLIPYSYYYGMDV

SEQ ID NO: 109 - protein, 12 aa, Artificial Sequence
  Synthetic: 9G7 VL1 CDR1
RASQSVSSSYLA

SEQ ID NO: 110 - protein, 7 aa, Artificial Sequence
  Synthetic: 9G7 VL1 CDR2
GASSRAT

SEQ ID NO: 111 - protein, 9 aa, Artificial Sequence
  Synthetic: 9G7 VL1 CDR3
QQYGSSPWT

SEQ ID NO: 112 - protein, 12 aa, Artificial Sequence
  Synthetic: 9G7 VL2 CDR1
RASQSVTSSYLA

SEQ ID NO: 113 - protein, 7 aa, Artificial Sequence
  Synthetic: 9G7 VL2 CDR2
GASSRAT

SEQ ID NO: 114 - protein, 9 aa, Artificial Sequence
  Synthetic: 9G7 VL2 CDR3
QQYGSSPIT

SEQ ID NO: 115 - protein, 117 aa, Artificial Sequence
  Synthetic: 14E3 (VH)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSS

SEQ ID NO: 116 - protein, 107 aa, Artificial Sequence
  Synthetic: 14E3 (VL)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIK

SEQ ID NO: 117 - protein, 447 aa, Artificial Sequence
  Synthetic: 14E3 (full length wild-type heavy chain)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 214 aa, Artificial Sequence
  Synthetic: 14E3 (full length wild-type light chain)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 446 aa, Artificial Sequence
  Synthetic: 14E3.IgG1 (VH + IgG1)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 120 - protein, 446 aa, Artificial Sequence
  Synthetic: 14E3.IgG1.1 (VH + IgG1.1)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 121 - protein, 214 aa, Artificial Sequence; identical to SEQ ID NO: 118
  Synthetic: 14E3.IgG1 (VL + CL)

SEQ ID NO: 122 - protein, 5 aa, Artificial Sequence
  Synthetic: 14E3 VH CDR1
GYYWS

SEQ ID NO: 123 - protein, 16 aa, Artificial Sequence
  Synthetic: 14E3 VH CDR2
EINHSGNTYYNPSLKS

SEQ ID NO: 124 - protein, 9 aa, Artificial Sequence
  Synthetic: 14E3 VH CDR3
FGSNDAFDI

SEQ ID NO: 125 - protein, 11 aa, Artificial Sequence
  Synthetic: 14E3 VL CDR1
RASQGISSWLA

SEQ ID NO: 126 - protein, 7 aa, Artificial Sequence
  Synthetic: 14E3 VL CDR2
AASSLQS

SEQ ID NO: 127 - protein, 9 aa, Artificial Sequence
  Synthetic: 14E3 VL CDR3
QQYNSYPPT

SEQ ID NO: 128 - protein, 124 aa, Artificial Sequence
  Synthetic: 19H8 (VH)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSS

SEQ ID NO: 129 - protein, 107 aa, Artificial Sequence
  Synthetic: 19H8 (VL1)
AIQLTQSPSSLSASVGDRVTITCRASQGISSALAWYQQKPGKAPKFLIYDASSLESGVPSRFSGSGSGTDFTLTISSLQPEDFATYYCQQFNSYPQTFGQGTKVEIK

SEQ ID NO: 130 - protein, 107 aa, Artificial Sequence
  Synthetic: 19H8 (VL2)
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 131 - protein, 450 aa, Artificial Sequence
  Synthetic: 19H8 (full length wild-type heavy chain)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 132 - protein, 214 aa, Artificial Sequence
  Synthetic: 19H8 L1 (full length wild-type light chain 1)
AIQLTQSPSSLSASVGDRVTITCRASQGISSALAWYQQKPGKAPKFLIYDASSLESGVPSRFSGSGSGTDFTLTISSLQPEDFATYYCQQFNSYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 214 aa, Artificial Sequence
  Synthetic: 19H8 L2 (full length wild-type light chain 2)
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 453 aa, Artificial Sequence
  Synthetic: 19H8.IgG1 (VH + IgG1)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 135 - protein, 453 aa, Artificial Sequence
  Synthetic: 19H8.IgG1.1 (VH + IgG1.1)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 136 - protein, 214 aa, Artificial Sequence; identical to SEQ ID NO: 132
  Synthetic: 19H8.IgG1 (VL1 + CL)

SEQ ID NO: 137 - protein, 214 aa, Artificial Sequence; identical to SEQ ID NO: 133
  Synthetic: 19H8.IgG1.2 (VL2 + CL)

SEQ ID NO: 138 - protein, 5 aa, Artificial Sequence
  Synthetic: 19H8 VH CDR1
NYGMH

SEQ ID NO: 139 - protein, 17 aa, Artificial Sequence
  Synthetic: 19H8 VH CDR2
VIWYGGSNKFYADSVKG

SEQ ID NO: 140 - protein, 15 aa, Artificial Sequence
  Synthetic: 19H8 VH CDR3
GGAMVRGVYYYGMDV

SEQ ID NO: 141 - protein, 11 aa, Artificial Sequence
  Synthetic: 19H8 VL1 CDR1
RASQGISSALA

SEQ ID NO: 142 - protein, 7 aa, Artificial Sequence
  Synthetic: 19H8 VL1 CDR2
DASSLES

SEQ ID NO: 143 - protein, 9 aa, Artificial Sequence
  Synthetic: 19H8 VL1 CDR3
QQFNSYPQT

SEQ ID NO: 144 - protein, 11 aa, Artificial Sequence
  Synthetic: 19H8 VL2 CDR1
RASQSVSSYLA

SEQ ID NO: 145 - protein, 7 aa, Artificial Sequence
  Synthetic: 19H8 VL2 CDR2
DASNRAT

SEQ ID NO: 146 - protein, 9 aa, Artificial Sequence
  Synthetic: 19H8 VL2 CDR3
QQRSNWPLT

SEQ ID NO: 147 - DNA, 372 bp, Artificial Sequence
  Synthetic: 28F3 (VH) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctca

SEQ ID NO: 148 - DNA, 321 bp, Artificial Sequence
  Synthetic: 28F3 (VL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 149 - DNA, 1350 bp, Artificial Sequence
  Synthetic: 28F3 (full length wild-type heavy chain) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 150 - DNA, 642 bp, Artificial Sequence
  Synthetic: 28F3 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 151 - DNA, 1362 bp, Artificial Sequence
  Synthetic: 28F3.IgG1 (VH + IgG1) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 152 - DNA, 1362 bp, Artificial Sequence
  Synthetic: 28F3.IgG1.1 (VH + IgG1.1) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 153 - DNA, 645 bp, Artificial Sequence
  Synthetic: 28F3.IgG1 (VL + CL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 154 - DNA, 369 bp, Artificial Sequence
  Synthetic: 19D3 (VH) nucleotide sequence
caggtgcagctggtggagtctgggggaggcgtggtccaacctgggaggtccctgagactctcctgtgcagcgtctggattcaccttcagtagctatggcttccactgggtccgccaggctccaggcaaggggctggagtgggtggcagttatatggtatgctggaagtaataaattctatgcagactccgtgaagggccgattcaccatctccagagacaattccaagaacacgctgtatctgcaaatgaacagcctaagagccgaggacacggctgtgtattactgtgcgagagggggacagttggactactactactattacgttatggacgtctggggccaagggaccacggtcaccgtctcctca

SEQ ID NO: 155 - DNA, 321 bp, Artificial Sequence
  Synthetic: 19D3 (VL) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgtacacttttggccaggggaccaagctggagatcaaa

SEQ ID NO: 156 - DNA, 1347 bp, Artificial Sequence
  Synthetic: 19D3 (full length wild-type heavy chain) nucleotide sequence
caggtgcagctggtggagtctgggggaggcgtggtccaacctgggaggtccctgagactctcctgtgcagcgtctggattcaccttcagtagctatggcttccactgggtccgccaggctccaggcaaggggctggagtgggtggcagttatatggtatgctggaagtaataaattctatgcagactccgtgaagggccgattcaccatctccagagacaattccaagaacacgctgtatctgcaaatgaacagcctaagagccgaggacacggctgtgtattactgtgcgagagggggacagttggactactactactattacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 157 - DNA, 642 bp, Artificial Sequence
  Synthetic: 19D3 (full length wild-type light chain) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 158 - DNA, 369 bp, Artificial Sequence
  Synthetic: 18E10 (VH) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggcgtatagcagtggccttctactacagtatggacgtctggggccaagggaccacggtcaccgtctcctca

SEQ ID NO: 159 - DNA, 321 bp, Artificial Sequence; identical to SEQ ID NO: 155
  Synthetic: 18E10 (VL) nucleotide sequence

SEQ ID NO: 160 - DNA, 1347 bp, Artificial Sequence
  Synthetic: 18E10 (full length wild-type heavy chain) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggcgtatagcagtggccttctactacagtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 161 - DNA, 642 bp, Artificial Sequence; identical to SEQ ID NO: 157
  Synthetic: 18E10 (full length wild-type light chain) nucleotide sequence

SEQ ID NO: 162 - DNA, 351 bp, Artificial Sequence
  Synthetic: 3C3 (VH) nucleotide sequence
caggtgcaactacagcagtggggcgcaggactgttgaagccttcggagaccctgtccctcacctgcgctgtctatggtgggtccttcagtggttactactggacctggatccgccagcccccagggaaggggctggagtggattgggaaaatcaatcatagtggaaacaccaactacaacccgtccctcaagagtcgagtcaccatatcagtagacacgtccaagaaccagttctccctgaagctgagctctgtgaccgccgcggacacggctgtgtattactgtgcgagactgggggcctttgatgcttttgatatctggggccaagggacaatggtcaccgtctcttca

SEQ ID NO: 163 - DNA, 321 bp, Artificial Sequence; identical to SEQ ID NO: 155
  Synthetic: 3C3 (VL1) nucleotide sequence

SEQ ID NO: 164 - DNA, 318 bp, Artificial Sequence
  Synthetic: 3C3 (VL2) nucleotide sequence
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcacacttttggccaggggaccaagctggagatcaaa

SEQ ID NO: 165 - DNA, 1341 bp, Artificial Sequence
  Synthetic: 3C3 (full length wild-type heavy chain) nucleotide sequence
caggtgcaactacagcagtggggcgcaggactgttgaagccttcggagaccctgtccctcacctgcgctgtctatggtgggtccttcagtggttactactggacctggatccgccagcccccagggaaggggctggagtggattgggaaaatcaatcatagtggaaacaccaactacaacccgtccctcaagagtcgagtcaccatatcagtagacacgtccaagaaccagttctccctgaagctgagctctgtgaccgccgcggacacggctgtgtattactgtgcgagactgggggcctttgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 166 - DNA, 642 bp, Artificial Sequence; identical to SEQ ID NO: 157
  Synthetic: 3C3 L1 (full length wild-type light chain) nucleotide sequence

SEQ ID NO: 167 - DNA, 639 bp, Artificial Sequence
  Synthetic: 3C3 L2 (full length wild-type light chain) nucleotide sequence
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 168 - DNA, 372 bp, Artificial Sequence
  Synthetic: 2G6 (VH) nucleotide sequence
caggttcagctggtggagtctgggggaggcgtggtccagcctggggggtccctgagactctcctgtgcagcgtctggattcatcttgagtgactatggcatgcactgggtccgccaggctccaggcaagggactggagtgggtgacagttatctggtatgatggaagtaataaattctatgtagactccgtgaagggccgattcaccatctccagagacaattccaagaacacgttgtatctgcaaatgaacagcctgagagtcgaggacacggctgtgtattactgtgcgagagggggacgtctagcaacaggtcacttctactacgttatggacgtctggggccaagggaccacggtcaccgtctcctca

SEQ ID NO: 169 - DNA, 321 bp, Artificial Sequence; identical to SEQ ID NO: 155
  Synthetic: 2G6 (VL) nucleotide sequence

SEQ ID NO: 170 - DNA, 1350 bp, Artificial Sequence
  Synthetic: 2G6 (full length wild-type heavy chain) nucleotide sequence
caggttcagctggtggagtctgggggaggcgtggtccagcctggggggtccctgagactctcctgtgcagcgtctggattcatcttgagtgactatggcatgcactgggtccgccaggctccaggcaagggactggagtgggtgacagttatctggtatgatggaagtaataaattctatgtagactccgtgaagggccgattcaccatctccagagacaattccaagaacacgttgtatctgcaaatgaacagcctgagagtcgaggacacggctgtgtattactgtgcgagagggggacgtctagcaacaggtcacttctactacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 171 - DNA, 642 bp, Artificial Sequence; identical to SEQ ID NO: 157
  Synthetic: 2G6 (full length wild-type light chain) nucleotide sequence

SEQ ID NO: 172 - DNA, 372 bp, Artificial Sequence
  Synthetic: 8A6 (VH) nucleotide sequence
caggtgcagctggtggagtctgggggaggcgtggtccagcctgggaggtccctgagactctcctgtacagcgtctggattcaccttcagtagctatggcatgcagtgggtccgccaggctccaggcaaggggctggagtgggtggcagttatatggtatgaaggaagtaataaatactatgcagactccgtgaagggccgattcaccatctccagagaaaattccaagaacacgctgtatctgcaaatgaacagcctgagagccgaggacacggctgtgtattactgtgcgagaggcggtcttatggttcggggtctcttctactacggtatggacgtctggggccaagggaccacggtcaccgtctcctca

SEQ ID NO: 173 - DNA, 321 bp, Artificial Sequence
  Synthetic: 8A6 (VL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 174 - DNA, 1350 bp, Artificial Sequence
  Synthetic: 8A6 (full length wild-type heavy chain) nucleotide sequence
caggtgcagctggtggagtctgggggaggcgtggtccagcctgggaggtccctgagactctcctgtacagcgtctggattcaccttcagtagctatggcatgcagtgggtccgccaggctccaggcaaggggctggagtgggtggcagttatatggtatgaaggaagtaataaatactatgcagactccgtgaagggccgattcaccatctccagagaaaattccaagaacacgctgtatctgcaaatgaacagcctgagagccgaggacacggctgtgtattactgtgcgagaggcggtcttatggttcggggtctcttctactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 175 - DNA, 642 bp, Artificial Sequence
  Synthetic: 8A6 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 176 - DNA, 375 bp, Artificial Sequence
  Synthetic: 9G7 (VH) nucleotide sequence
gaggtgcagctggtggagtctgggggaggcttagtaaagcctggggggtcccttagactctcctgtgcagcctctggattcactttcagtaccgtctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgcacaccgaggacacagccgtgtattactgtaccacagggcagctgatcccttactcctactactacggtatggacgtctggggccaagggacctcggtcaccgtctcctca

SEQ ID NO: 177 - DNA, 324 bp, Artificial Sequence
  Synthetic: 9G7 (VL1) nucleotide sequence
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaa

SEQ ID NO: 178 - DNA, 324 bp, Artificial Sequence
  Synthetic: 9G7 (VL2) nucleotide sequence
gaaattgtgttgacgcagtctccaggcaccctgtctttgtctccaggggaaagagccaccctctcctgcagggccagtcagagtgttaccagcagctacttagcctggtaccagcagaaacctggccaggctcccaggctcctcatctatggtgcatccagcagggccactggcatcccagagaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 179 - DNA, 1356 bp, Artificial Sequence
  Synthetic: 9G7 (full length wild-type heavy chain) nucleotide sequence
gaggtgcagctggtggagtctgggggaggcttagtaaagcctggggggtcccttagactctcctgtgcagcctctggattcactttcagtaccgtctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgcacaccgaggacacagccgtgtattactgtaccacagggcagctgatcccttactcctactactacggtatggacgtctggggccaagggacctcggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 180 - DNA, 645 bp, Artificial Sequence
  Synthetic: 9G7 L2 (full length wild-type light chain) nucleotide sequence
gaaattgtgttgacgcagtctccaggcaccctgtctttgtctccaggggaaagagccaccctctcctgcagggccagtcagagtgttaccagcagctacttagcctggtaccagcagaaacctggccaggctcccaggctcctcatctatggtgcatccagcagggccactggcatcccagagaggttcagtggcagtgggtctgggacagacttcactctcaccatcagcagactggagcctgaagattttgcagtgtattactgtcagcagtatggtagctcaccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 181 - DNA, 645 bp, Artificial Sequence
  Synthetic: 9G7 L1 (full length wild-type light chain) nucleotide sequence
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 182 - DNA, 351 bp, Artificial Sequence
  Synthetic: 14E3 (VH) nucleotide sequence
caggtgcagctacagcagtggggcgcaggactgttgaagccttcggagaccctgtccctcacctgcgctgtctatggtgggtccttcagtggttactactggagctggatccgccagcccccagggaaggggctggagtggattggagaaatcaatcatagtggaaacacctactacaacccgtccctcaagagtcgcgtcaccatatcagtagacacgtccaagaaccagttatccctgaagctgagctctgtgaccgccgcggacacggctgtgtattactgtgcgagatttgggagtaatgatgcttttgatatctggggccaagggacaatggtcaccgtctcttca

SEQ ID NO: 183 - DNA, 321 bp, Artificial Sequence
  Synthetic: 14E3 (VL) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaa

SEQ ID NO: 184 - DNA, 1341 bp, Artificial Sequence
  Synthetic: 14E3 (full length wild-type heavy chain) nucleotide sequence
caggtgcagctacagcagtggggcgcaggactgttgaagccttcggagaccctgtccctcacctgcgctgtctatggtgggtccttcagtggttactactggagctggatccgccagcccccagggaaggggctggagtggattggagaaatcaatcatagtggaaacacctactacaacccgtccctcaagagtcgcgtcaccatatcagtagacacgtccaagaaccagttatccctgaagctgagctctgtgaccgccgcggacacggctgtgtattactgtgcgagatttgggagtaatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 185 - DNA, 642 bp, Artificial Sequence
  Synthetic: 14E3 (full length wild-type light chain) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 186 - DNA, 372 bp, Artificial Sequence
  Synthetic: 19H8 (VH) nucleotide sequence
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggatggcagttatatggtatggtggaagtaataaattctatgcagactccgtgaagggccgattcaccatctccagagacaattccaagaactcgctgtctctgcaaatgaacagcctgagagccgaggacacggctgtgtattactgtgcgagagggggggctatggttcggggagtctactactacggtatggacgtctggggccaagggaccacggtcaccgtctcctca

SEQ ID NO: 187 - DNA, 321 bp, Artificial Sequence
  Synthetic: 19H8 (VL1) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagacgttcggccaagggaccaaggtggaaatcaaa

SEQ ID NO: 188 - DNA, 321 bp, Artificial Sequence
  Synthetic: 19H8 (VL2) nucleotide sequence
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 189 - DNA, 1350 bp, Artificial Sequence
  Synthetic: 19H8 (full length wild-type heavy chain) nucleotide sequence
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggatggcagttatatggtatggtggaagtaataaattctatgcagactccgtgaagggccgattcaccatctccagagacaattccaagaactcgctgtctctgcaaatgaacagcctgagagccgaggacacggctgtgtattactgtgcgagagggggggctatggttcggggagtctactactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 190 - DNA, 642 bp, Artificial Sequence
  Synthetic: 19H8 L1 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 191 - DNA, 642 bp, Artificial Sequence
  Synthetic: 19H8 L2 (full length wild-type light chain) nucleotide sequence
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - protein, 98 aa, Artificial Sequence
  Synthetic: VH 3-33 (28F3, 18E10, 19D3, 2G6, 8A6, 19H8)
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 193 - protein, 4 aa, Artificial Sequence
  Synthetic: VH 3-10 (28F3, 8A6)
MVRG

SEQ ID NO: 194 - protein, 4 aa, Artificial Sequence
  Synthetic: VH 3-10 (9G7)
YYYG

SEQ ID NO: 195 - protein, 3 aa, Artificial Sequence
  Synthetic: VH 3-10 (19H8)
YYY

SEQ ID NO: 196 - protein, 18 aa, Artificial Sequence
  Synthetic: VH JH6 (28F3, 19H8)
YYYGMDVWGQGTTVTVSS

SEQ ID NO: 197 - protein, 17 aa, Artificial Sequence
  Synthetic: VH JH6 (18E10, 2G6, 8A6)
YYGMDVWGQGTTVTVSS

SEQ ID NO: 198 - protein, 20 aa, Artificial Sequence
  Synthetic: VH JH6 (19D3, 9G7)
YYYYYGMDVWGQGTTVTVSS

SEQ ID NO: 199 - protein, 4 aa, Artificial Sequence
  Synthetic: VH 6-19 (18E10)
IAVA

SEQ ID NO: 200 - protein, 2 aa, Artificial Sequence
  Synthetic: VH 3-16 (19D3)
DY

SEQ ID NO: 201 - protein, 97 aa, Artificial Sequence
  Synthetic: VH 4-34 (3C3, 14E3)
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR

SEQ ID NO: 202 - protein, 16 aa, Artificial Sequence
  Synthetic: VH JH3 (3C3, 14E3)
DAFDIWGQGTMVTVSS

SEQ ID NO: 203 - protein, 100 aa, Artificial Sequence
  Synthetic: VH 3-15 (9G7)
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT

SEQ ID NO: 204 - protein, 94 aa, Artificial Sequence
  Synthetic: VL L18 (28F3, 8A6, 19H8VK1)
AIQLTQSPSSLSASVGDRVTITCRASQGISSALAWYQQKPGKAPKLLIYDASSLESGVPSRFSGSGSGTDFTLTISSLQPEDFATYYCQQFNNY

SEQ ID NO: 205 - protein, 12 aa, Artificial Sequence
  Synthetic: VL JK2 (28F3, 18E10, 19D3, 3C3VK1, 8A6, 2G6)
YTFGQGTKLEIK

SEQ ID NO: 206 - protein, 11 aa, Artificial Sequence
  Synthetic: VL JK2 (3C3VK2)
TFGQGTKLEIK

SEQ ID NO: 207 - protein, 94 aa, Artificial Sequence
  Synthetic: VL L15 (18E10, 19D3, 3C3VK1, 2G6, 14E3)
DIQMTQSPSSLSASVGDRVTITCRASQGISSWLAWYQQKPEKAPKSLIYAASSLQSGVPSRFSGSGSGTDFTLTISSLQPEDFATYYCQQYNSY

SEQ ID NO: 208 - protein, 94 aa, Artificial Sequence
  Synthetic: VL L20 (3C3VK2)
EIVLTQSPATLSLSPGERATLSCRASQGVSSYLAWYQQKPGQAPRLLIYDASNRATGIPARFSGSGPGTDFTLTISSLEPEDFAVYYCQQRSNW

SEQ ID NO: 209 - protein, 95 aa, Artificial Sequence
  Synthetic: VL A27 (9G7VK1, 9G7VK2)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSS

SEQ ID NO: 210 - protein, 12 aa, Artificial Sequence
  Synthetic: VL JK1 (9G7VK1)
WTFGQGTKVEIK

SEQ ID NO: 211 - protein, 11 aa, Artificial Sequence
  Synthetic: VL JK1 (14E3, 19H8VK1)
TFGQGTKVEIK

SEQ ID NO: 212 - protein, 12 aa, Artificial Sequence
  Synthetic: VL JK5 (9G7VK2)
ITFGQGTRLEIK

SEQ ID NO: 213 - protein, 94 aa, Artificial Sequence
  Synthetic: VL L6 (19H8VK2)
EIVLTQSPATLSLSPGERATLSCRASQSVSSYLAWYQQKPGQAPRLLIYDASNRATGIPARFSGSGSGTDFTLTISSLEPEDFAVYYCQQRSNW

SEQ ID NO: 214 - protein, 12 aa, Artificial Sequence
  Synthetic: VL JK4 (19H8VK2)
LTFGGGTKVEIK

SEQ ID NO: 215 - protein, 39 aa, Artificial Sequence
  Synthetic: GITR epitope
QRPTGGPGCGPGRLLLGTGTDARCCRVHTTRCCRDYPGE

SEQ ID NO: 216 - protein, 20 aa, Artificial Sequence
  Synthetic: GITR epitope
QRPTGGPGCGPGRLLLGTGT

SEQ ID NO: 217 - protein, 18 aa, Artificial Sequence
  Synthetic: GITR epitope (region 1)
PTGGPGCGPGRLLLGTGT

SEQ ID NO: 218 - protein, 8 aa, Artificial Sequence
  Synthetic: GITR epitope (region 2)
CRDYPGEE

SEQ ID NO: 219 - protein, 5 aa, Artificial Sequence
  Synthetic: Peptide linker
PVGVV

SEQ ID NO: 220 - protein, 5 aa, Artificial Sequence
  Synthetic: Heavy chain C-terminus
LSPGK

SEQ ID NO: 221 - protein, 325 aa, Artificial Sequence
  Synthetic: G2 constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 222 - protein, 325 aa, Artificial Sequence
  Synthetic: G2(C219S) constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 223 - protein, 326 aa, Artificial Sequence
  Synthetic: G2.g1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 325 aa, Artificial Sequence
  Synthetic: G2.g1.1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 225 - protein, 326 aa, Artificial Sequence
  Synthetic: G2(C219S).g1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 325 aa, Artificial Sequence
  Synthetic: G2(C219S).g1.1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 227 - protein, 449 aa, Artificial Sequence
  Synthetic: 28F3 (VH + G2(C219S))  or 28F3-IgG2-C219S
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 228 - protein, 450 aa, Artificial Sequence
  Synthetic: 28F3 (VH + G2.g1)  or 28F3-IgG2-IgG1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 229 - protein, 449 aa, Artificial Sequence
  Synthetic: 28F3 (VH + G2.g1.1)  or 28F3-IgG2-IgG1.1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 230 - protein, 450 aa, Artificial Sequence
  Synthetic: 28F3 (VH + G2(C219S).g1) or 28F3-IgG2-C219S-IgG1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 231 - protein, 449 aa, Artificial Sequence
  Synthetic: 28F3 (VH + G2(C219S).g1.1)  or 28F3-IgG2-C219S-IgG1.1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - protein, 448 aa, Artificial Sequence
  Synthetic: 19D3 (VH + G2(C219S))  or 19D3-IgG2-C219S
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 233 - protein, 449 aa, Artificial Sequence
  Synthetic: 19D3 (VH + G2.g1)  or 19D3-IgG2-IgG1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 234 - protein, 448 aa, Artificial Sequence
  Synthetic: 19D3 (VH + G2.g1.1)  or 19D3-IgG2-IgG1.1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 235 - protein, 449 aa, Artificial Sequence
  Synthetic: 19D3 (VH + G2(C219S).g1) or 19D3-IgG2-C219S-IgG1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 236 - protein, 448 aa, Artificial Sequence
  Synthetic: 19D3 (VH + G2(C219S).g1.1)  or 19D3-IgG2-C219S-IgG1.1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 237 - protein, 448 aa, Artificial Sequence
  Synthetic: 18E10 (VH + G2(C219S))  or 18E10-IgG2-C219S
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 238 - protein, 449 aa, Artificial Sequence
  Synthetic: 18E10 (VH + G2.g1)  or 18E10-IgG2-IgG1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 239 - protein, 448 aa, Artificial Sequence
  Synthetic: 18E10 (VH + G2.g1.1)  or 18E10-IgG2-IgG1.1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - protein, 449 aa, Artificial Sequence
  Synthetic: 18E10 (VH + G2(C219S).g1) or 18E10-IgG2-C219S-IgG1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 241 - protein, 448 aa, Artificial Sequence
  Synthetic: 18E10 (VH + G2(C219S).g1.1)  or 18E10-IgG2-C219S-IgG1.1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 242 - protein, 442 aa, Artificial Sequence
  Synthetic: 3C3 (VH + G2) or 3C3-IgG2
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 243 - protein, 442 aa, Artificial Sequence
  Synthetic: 3C3 (VH + G2(C219S))  or 3C3-IgG2-C219S
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 244 - protein, 443 aa, Artificial Sequence
  Synthetic: 3C3 (VH + G2.g1)  or 3C3-IgG2-IgG1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 245 - protein, 442 aa, Artificial Sequence
  Synthetic: 3C3 (VH + G2.g1.1)  or 3C3-IgG2-IgG1.1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 246 - protein, 443 aa, Artificial Sequence
  Synthetic: 3C3 (VH + G2(C219S).g1) or 3C3-IgG2-C219S-IgG1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 247 - protein, 442 aa, Artificial Sequence
  Synthetic: 3C3 (VH + G2(C219S).g1.1)  or 3C3-IgG2-C219S-IgG1.1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 248 - protein, 449 aa, Artificial Sequence
  Synthetic: 2G6 (VH + G2) or 2G6-IgG2
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 249 - protein, 449 aa, Artificial Sequence
  Synthetic: 2G6 (VH + G2(C219S))  or 2G6-IgG2-C219S
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 250 - protein, 450 aa, Artificial Sequence
  Synthetic: 2G6 (VH + G2.g1)  or 2G6-IgG2-IgG1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 251 - protein, 449 aa, Artificial Sequence
  Synthetic: 2G6  (VH + G2.g1.1)  or 2G6-IgG2-IgG1.1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 252 - protein, 450 aa, Artificial Sequence
  Synthetic: 2G6 (VH + G2(C219S).g1) or 2G6-IgG2-C219S-IgG1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 253 - protein, 449 aa, Artificial Sequence
  Synthetic: 2G6 (VH + G2(C219S).g1.1)  or 2G6-IgG2-C219S-IgG1.1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 254 - protein, 449 aa, Artificial Sequence
  Synthetic: 8A6 (VH + G2(C219S))  or 8A6-IgG2-C219S
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 255 - protein, 450 aa, Artificial Sequence
  Synthetic: 8A6 (VH + G2.g1)  or 8A6 -IgG2-IgG1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 256 - protein, 449 aa, Artificial Sequence
  Synthetic: 8A6 (VH + G2.g1.1)  or 8A6 -IgG2-IgG1.1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 257 - protein, 450 aa, Artificial Sequence
  Synthetic: 8A6 (VH + G2(C219S).g1) or 8A6-IgG2-C219S-IgG1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 258 - protein, 449 aa, Artificial Sequence
  Synthetic: 8A6 (VH + G2(C219S).g1.1)  or 8A6-IgG2-C219S-IgG1.1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 259 - protein, 450 aa, Artificial Sequence
  Synthetic: 9G7 (VH + G2) or 9G7-IgG2
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 260 - protein, 450 aa, Artificial Sequence
  Synthetic: 9G7 (VH + G2(C219S))  or 9G7-IgG2-C219S
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 261 - protein, 451 aa, Artificial Sequence
  Synthetic: 9G7 (VH + G2.g1)  or 9G7-IgG2-IgG1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 262 - protein, 450 aa, Artificial Sequence
  Synthetic: 9G7 (VH + G2.g1.1)  or 9G7-IgG2-IgG1.1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 263 - protein, 451 aa, Artificial Sequence
  Synthetic: 9G7 (VH + G2(C219S).g1) or 9G7-IgG2-C219S-IgG1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 450 aa, Artificial Sequence
  Synthetic: 9G7 (VH + G2(C219S).g1.1)  or 9G7-IgG2-C219S-IgG1.1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 265 - protein, 442 aa, Artificial Sequence
  Synthetic: 14E3 (VH + G2) or 14E3-IgG2
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 266 - protein, 442 aa, Artificial Sequence
  Synthetic: 14E3 (VH + G2(C219S))  or 14E3-IgG2-C219S
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 267 - protein, 443 aa, Artificial Sequence
  Synthetic: 14E3 (VH + G2.g1)  or 14E3-IgG2-IgG1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 442 aa, Artificial Sequence
  Synthetic: 14E3 (VH + G2.g1.1)  or 14E3-IgG2-IgG1.1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - protein, 443 aa, Artificial Sequence
  Synthetic: 14E3 (VH + G2(C219S).g1) or 14E3-IgG2-C219S-IgG1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 270 - protein, 442 aa, Artificial Sequence
  Synthetic: 14E3 (VH + G2(C219S).g1.1)  or 14E3-IgG2-C219S-IgG1.1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 449 aa, Artificial Sequence
  Synthetic: 19H8 (VH + G2(C219S))  or 19H8-IgG2-C219S
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 272 - protein, 450 aa, Artificial Sequence
  Synthetic: 19H8 (VH + G2.g1)  or 19H8-IgG2-IgG1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 273 - protein, 449 aa, Artificial Sequence
  Synthetic: 19H8 (VH + G2.g1.1)  or 19H8-IgG2-IgG1.1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 274 - protein, 450 aa, Artificial Sequence
  Synthetic: 19H8 (VH + G2(C219S).g1) or 19H8-IgG2-C219S-IgG1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 275 - protein, 449 aa, Artificial Sequence
  Synthetic: 19H8 (VH + G2(C219S).g1.1)  or 19H8-IgG2-C219S-IgG1.1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 4 aa, Artificial Sequence
  Synthetic: Heavy chain C-terminus
LSPG

SEQ ID NO: 277 - skipped

SEQ ID NO: 278 - protein, 98 aa, Homo sapiens
  misc_feature (1)..(98): Wildtype human IgG1 CH1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 279 - protein, 98 aa, Homo sapiens
  misc_feature (1)..(98): Wildtype human IgG2 CH1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 280 - protein, 103 aa, Homo sapiens
  misc_feature (1)..(103): Wildtype human IgG1 CH2
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 281 - protein, 103 aa, Homo sapiens
  misc_feature (1)..(103): Human IgG1 CH2 with A330S/P331S
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAK

SEQ ID NO: 282 - protein, 106 aa, Homo sapiens
  misc_feature (1)..(106): Wildtype human IgG1 CH3
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - protein, 326 aa, Artificial Sequence
  Synthetic: IgG1-IgG2-IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 325 aa, Artificial Sequence
  Synthetic: IgG1-IgG2CS-IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - protein, 325 aa, Artificial Sequence
  Synthetic: IgG1-IgG2-IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRREMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 286 - protein, 325 aa, Artificial Sequence
  Synthetic: IgG1-IgG2CS-IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - protein, 325 aa, Artificial Sequence
  Synthetic: IgG1-IgG2-1gG1f2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 325 aa, Artificial Sequence; identical to SEQ ID NO: 284
  Synthetic: IgG1-IgG2(C219S)-IgG1f2

SEQ ID NO: 289 - protein, 325 aa, Artificial Sequence
  Synthetic: IgG2-IgG1f2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 290 - protein, 325 aa, Artificial Sequence
  Synthetic: IgG2(C219S)-IgG1f2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 291 - protein, 18 aa, Homo sapiens
  misc_feature (1)..(18): WT human IgG2 hinge
ERKCCVECPPCPAPPVAG

SEQ ID NO: 292 - protein, 18 aa, Homo sapiens
  misc_feature (1)..(18): Human IgG2 hinge with C219S
ERKSCVECPPCPAPPVAG

SEQ ID NO: 293 - protein, 19 aa, Artificial Sequence
  Synthetic: IgG2/IgG1 hinge
ERKCCVECPPCPAPELLGG

SEQ ID NO: 294 - protein, 19 aa, Artificial Sequence
  Synthetic: IgG2 (C219S)/IgG1 hinge
ERKSCVECPPCPAPELLGG

SEQ ID NO: 295 - protein, 22 aa, Homo sapiens
  misc_feature (1)..(22): Wild type human IgG1 hinge
EPKSCDKTHTCPPCPAPELLGG

SEQ ID NO: 296 - protein, 22 aa, Artificial Sequence
  Synthetic: IgG1.1 Hinge (L234A/L235E/G237A)
EPKSCDKTHTCPPCPAPEAEGA

SEQ ID NO: 297 - protein, 103 aa, Homo sapiens
  misc_feature (1)..(103): Wildtype human IgG2 CH2
PSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTK

SEQ ID NO: 298 - protein, 107 aa, Homo sapiens
  misc_feature (1)..(107): Wildtype human IgG2 CH3
GQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 299 - protein, 5 aa, Artificial Sequence
  Synthetic: IgG1 C-termianl CH1 (same for IgG3 (17-15-15-15), igG3 (17-15-15), IgG3 (17-15), IgG3 (15-15-15), IgG3 (15), and IgG4
VDKRV

SEQ ID NO: 300 - protein, 5 aa, Artificial Sequence
  Synthetic: IgG2 C-termianl CH1
VDKTV

SEQ ID NO: 301 - protein, 10 aa, Artificial Sequence
  Synthetic: IgG1 upper hinge
EPKSCDKTHT

SEQ ID NO: 302 - protein, 12 aa, Artificial Sequence
  Synthetic: IgG3 (17-15-15-15) upper hinge (same for IgG3 (17-15-15) and IgG3 (17-15))
ELKTPLGDTTHT

SEQ ID NO: 303 - protein, 4 aa, Artificial Sequence
  Synthetic: IgG3 (15-15-15) upper hinge (same for IgG3(15))
EPKS

SEQ ID NO: 304 - protein, 7 aa, Artificial Sequence
  Synthetic: IgG4 upper hinge
ESKYGPP

SEQ ID NO: 305 - protein, 5 aa, Artificial Sequence
  Synthetic: IgG1 middle hinge
CPPCP

SEQ ID NO: 306 - protein, 9 aa, Artificial Sequence
  Synthetic: IgG2 middle hinge
CCVECPPCP

SEQ ID NO: 307 - protein, 50 aa, Artificial Sequence
  Synthetic: IgG3 (17-15-15-15) middle hinge
CPRCPEPKSCDTPPPCPRCPEPKSCDTPPPCPRCPEPKSCDTPPPCPRCP

SEQ ID NO: 308 - protein, 35 aa, Artificial Sequence
  Synthetic: IgG3 (17-15-15) middle hinge
CPRCPEPKSCDTPPPCPRCPEPKSCDTPPPCPRCP

SEQ ID NO: 309 - protein, 20 aa, Artificial Sequence
  Synthetic: IgG3 (17-15) middle hinge
CPRCPEPKSCDTPPPCPRCP

SEQ ID NO: 310 - protein, 41 aa, Artificial Sequence
  Synthetic: IgG3 (15-15-15) middle hinge
CDTPPPCPRCPEPKSCDTPPPCPRCPEPKSCDTPPPCPRCP

SEQ ID NO: 311 - protein, 11 aa, Artificial Sequence
  Synthetic: IgG3 (15) middle hinge
CDTPPPCPRCP

SEQ ID NO: 312 - protein, 5 aa, Artificial Sequence
  Synthetic: IgG4 middle hinge
CPSCP

SEQ ID NO: 313 - protein, 7 aa, Artificial Sequence
  Synthetic: IgG1 lower hinge (same for IgG3 (17-15-15-15), IgG3 (17-15-15), IgG3 (17-15), IgG3 (15-15-15), IgG3 (15), and IgG4)
APELLGG

SEQ ID NO: 314 - protein, 6 aa, Artificial Sequence
  Synthetic: IgG2 lower hinge
APPVAG

SEQ ID NO: 315 - protein, 19 aa, Artificial Sequence
  Synthetic: 28F3 VH signal sequence (same for 18E10, 19D3, 19H8, 6G10)
MEFGLSWVFLVALLRGVQC

SEQ ID NO: 316 - protein, 57 aa, Artificial Sequence
  Synthetic: 28F3 VH signal sequence (nucleotide sequence)
ATGGAGTTTGGGCTGAGCTGGGTTTTCCTCGTTGCTCTTTTAAGAGGTGTCCAGTGT

SEQ ID NO: 317 - protein, 22 aa, Artificial Sequence
  Synthetic: 28F3 VL signal sequence (same for 18E10, 8A6, 19H8VL1, 6G10)
MDMRVPAQLLGLLLLWLPGARC

SEQ ID NO: 318 - protein, 64 aa, Artificial Sequence
  Synthetic: 28F3 VL signal sequence (nucleotide sequence)
ATGGACATGAGGGTCCCCGCTCAGCTCCTGGGGCTTCTGCTGCTCTGGCTCCCAGGTGCCAGAT

SEQ ID NO: 319 - protein, 20 aa, Artificial Sequence
  Synthetic: 19D3 VL signal sequence
MRVLAQLLGLLLLCFPGARC

SEQ ID NO: 320 - protein, 60 aa, Artificial Sequence
  Synthetic: 19D3 VL signal sequence (nucleotide sequence)
ATGAGGGTCCTCGCTCAGCTCCTGGGGCTCCTGCTGCTCTGTTTCCCAGGTGCCAGATGT

SEQ ID NO: 321 - protein, 19 aa, Artificial Sequence
  Synthetic: 3C3 VH signal sequence (same for 14E3)
MKHLWFFLLLVAAPRWVLS

SEQ ID NO: 322 - protein, 57 aa, Artificial Sequence
  Synthetic: 3C3 VH signal sequence (nucleotide sequence)
ATGAAACACCTGTGGTTCTTCCTCCTCCTGGTGGCAGCTCCCAGATGGGTCCTGTCC

SEQ ID NO: 323 - protein, 22 aa, Artificial Sequence
  Synthetic: 3C3 VL signal sequence (same for 14E3)
MDMRVLAQLLGLLLLCFPGARC

SEQ ID NO: 324 - protein, 66 aa, Artificial Sequence
  Synthetic: 3C3 VL signal sequence (nucleotide sequence)
ATGGACATGAGGGTCCTCGCTCAGCTCCTGGGGCTCCTGCTGCTCTGTTTCCCAGGTGCCAGATGT

SEQ ID NO: 325 - protein, 20 aa, Artificial Sequence
  Synthetic: 3C3 VL2 signal sequence (same for 19H8 VL2)
MEAPAQLLFLLLLWLPDTTG

SEQ ID NO: 326 - protein, 60 aa, Artificial Sequence
  Synthetic: 3C3 VL2 signal sequence (nucleotide sequence)
ATGGAAGCCCCAGCGCAGCTTCTCTTCCTCCTGCTACTCTGGCTCCCAGATACCACCGGA

SEQ ID NO: 327 - protein, 19 aa, Artificial Sequence
  Synthetic: 8A6 VH signal sequence
MEFGLNWVFLVALLRGVQC

SEQ ID NO: 328 - protein, 57 aa, Artificial Sequence
  Synthetic: 8A6 VH signal sequence (nucleotide sequence)
ATGGAGTTTGGGCTGAACTGGGTTTTCCTCGTTGCTCTTTTAAGAGGTGTCCAGTGT

SEQ ID NO: 329 - protein, 19 aa, Artificial Sequence
  Synthetic: 9G7 VH signal sequence
MEFGLSWIFLAAILKGVQC

SEQ ID NO: 330 - protein, 57 aa, Artificial Sequence
  Synthetic: 9G7 VH signal sequence (nucleotide sequence)
ATGGAGTTTGGGCTGAGCTGGATTTTCCTTGCTGCTATTTTAAAAGGTGTCCAGTGT

SEQ ID NO: 331 - protein, 20 aa, Artificial Sequence
  Synthetic: 9G7 VL1 and VL2 signal sequence
METPAQLLFLLLLWLPDTTG

SEQ ID NO: 332 - protein, 60 aa, Artificial Sequence
  Synthetic: 9G7 VL1 and VL2 signal sequence (nucleotide sequence)
ATGGAAACCCCAGCGCAGCTTCTCTTCCTCCTGCTACTCTGGCTCCCAGATACCACCGGA

SEQ ID NO: 333 - protein, 19 aa, Artificial Sequence
  Synthetic: 14E3 VH signal sequence
MKHLWFFLLLVAAPRWVLS

SEQ ID NO: 334 - protein, 57 aa, Artificial Sequence; identical to SEQ ID NO: 322
  Synthetic: 14E3 VH signal sequence (nucleotide sequence)

SEQ ID NO: 335 - protein, 124 aa, Artificial Sequence
  Synthetic: 6G10 (VH)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSS

SEQ ID NO: 336 - protein, 107 aa, Artificial Sequence; identical to SEQ ID NO: 14
  Synthetic: 6G10 (VL)

SEQ ID NO: 337 - protein, 450 aa, Artificial Sequence
  Synthetic: 6G10 (full length wild-type heavy chain)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 338 - protein, 214 aa, Artificial Sequence; identical to SEQ ID NO: 16
  Synthetic: 6G10 (full length wild-type light chain)

SEQ ID NO: 339 - protein, 453 aa, Artificial Sequence
  Synthetic: 6G10.IgG1 (VH + IgG1)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 340 - protein, 453 aa, Artificial Sequence
  Synthetic: 6G10.IgG1.1 (VH + IgG1.1)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 341 - protein, 214 aa, Artificial Sequence; identical to SEQ ID NO: 16
  Synthetic: 6G10.IgG1 (VL + CL)

SEQ ID NO: 342 - protein, 5 aa, Artificial Sequence
  Synthetic: 6G10 VH CDR1
TYGMH

SEQ ID NO: 343 - protein, 17 aa, Artificial Sequence
  Synthetic: 6G10 VH CDR2
VTWYAGSNKFYADSVKG

SEQ ID NO: 344 - protein, 15 aa, Artificial Sequence
  Synthetic: 6G10 VH CDR3
GGSMVRGLYYYGMDV

SEQ ID NO: 345 - protein, 11 aa, Artificial Sequence
  Synthetic: 6G10 VL CDR1
RASQGISSALA

SEQ ID NO: 346 - protein, 7 aa, Artificial Sequence
  Synthetic: 6G10 VL CDR2
DASSLES

SEQ ID NO: 347 - protein, 9 aa, Artificial Sequence
  Synthetic: 6G10 VL CDR3
QQFNSYPYT

SEQ ID NO: 348 - protein, 449 aa, Artificial Sequence
  Synthetic: 6G10 (VH + G2(C219S)) or 6G10-IgG2-C219S
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 349 - protein, 450 aa, Artificial Sequence
  Synthetic: 6G10 (VH + G2.g1) or 6G10-IgG2-IgG1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 350 - protein, 449 aa, Artificial Sequence
  Synthetic: 6G10 (VH + G2.g1.1) or 6G10-IgG2-IgG1.1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 351 - protein, 450 aa, Artificial Sequence
  Synthetic: 6G10 (VH + G2(C219S).g1) or 6G10-IgG2-C219S-IgG1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 352 - protein, 449 aa, Artificial Sequence
  Synthetic: 6G10 (VH + G2(C219S).g1.1) or 6G10-IgG2-C219S-IgG1.1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 353 - protein, 372 aa, Artificial Sequence
  Synthetic: 6G10 (VH) nucleotide sequence
CAGGTGCAGCTGGTGGAGTCTGGGGGAGACGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAGTTACATGGTATGCTGGAAGTAATAAATTTTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGGAGGTAGTATGGTTCGGGGACTTTATTATTACGGTATGGACGTCTGGGGCCAAGGGACCACGGTCACCGTCTCCTCA

SEQ ID NO: 354 - protein, 321 aa, Artificial Sequence
  Synthetic: 6G10 (VL) nucleotide sequence
GCCATCCAGTTGACCCAGTCTCCATCCTCCCTGTCTGCATCTGTAGGAGACAGAGTCACCATCACTTGCCGGGCAAGTCAGGGCATTAGCAGTGCTTTAGCCTGGTATCAGCAGAAACCAGGGAAAGCTCCTAAGCTCCTGATCTATGATGCCTCCAGTTTGGAAAGTGGGGTCCCATCAAGGTTCAGCGGCAGTGGATCTGGGACAGATTTCACTCTCACCATCAGCAGCCTGCAGCCTGAAGATTTTGCAACTTATTACTGTCAACAGTTTAATAGTTACCCGTACACTTTTGGCCAGGGGACCAAGCTGGAGATCAAA

SEQ ID NO: 355 - protein, 1350 aa, Artificial Sequence
  Synthetic: 6G10 (full length wild-type heavy chain) nucleotide sequence
CAGGTGCAGCTGGTGGAGTCTGGGGGAGACGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAGTTACATGGTATGCTGGAAGTAATAAATTTTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGGAGGTAGTATGGTTCGGGGACTTTATTATTACGGTATGGACGTCTGGGGCCAAGGGACCACGGTCACCGTCTCCTCAGCCTCCACCAAGGGCCCATCGGTCTTCCCCCTGGCGCCCTGCTCCAGGAGCACCTCCGAGAGCACAGCGGCCCTGGGCTGCCTGGTCAAGGACTACTTCCCCGAACCGGTGACGGTGTCGTGGAACTCAGGCGCTCTGACCAGCGGCGTGCACACCTTCCCAGCTGTCCTACAGTCCTCAGGACTCTACTCCCTCAGCAGCGTGGTGACCGTGCCCTCCAGCAACTTCGGCACCCAGACCTACACCTGCAACGTAGATCACAAGCCCAGCAACACCAAGGTGGACAAGACAGTTGAGCGCAAATGTTGTGTCGAGTGCCCACCGTGCCCAGCACCACCTGTGGCAGGACCGTCAGTCTTCCTCTTCCCCCCAAAACCCAAGGACACCCTCATGATCTCCCGGACCCCTGAGGTCACGTGCGTGGTGGTGGACGTGAGCCACGAAGACCCCGAGGTCCAGTTCAACTGGTACGTGGACGGCGTGGAGGTGCATAATGCCAAGACAAAGCCACGGGAGGAGCAGTTCAACAGCACGTTCCGTGTGGTCAGCGTCCTCACCGTTGTGCACCAGGACTGGCTGAACGGCAAGGAGTACAAGTGCAAGGTCTCCAACAAAGGCCTCCCAGCCCCCATCGAGAAAACCATCTCCAAAACCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTACCCCAGCGACATCGCCGTGGAGTGGGAGAGCAATGGGCAGCCGGAGAACAACTACAAGACCACACCTCCCATGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA

SEQ ID NO: 356 - protein, 642 aa, Artificial Sequence
  Synthetic: 6G10 (full length wild-type light chain) nucleotide sequence
GCCATCCAGTTGACCCAGTCTCCATCCTCCCTGTCTGCATCTGTAGGAGACAGAGTCACCATCACTTGCCGGGCAAGTCAGGGCATTAGCAGTGCTTTAGCCTGGTATCAGCAGAAACCAGGGAAAGCTCCTAAGCTCCTGATCTATGATGCCTCCAGTTTGGAAAGTGGGGTCCCATCAAGGTTCAGCGGCAGTGGATCTGGGACAGATTTCACTCTCACCATCAGCAGCCTGCAGCCTGAAGATTTTGCAACTTATTACTGTCAACAGTTTAATAGTTACCCGTACACTTTTGGCCAGGGGACCAAGCTGGAGATCAAACGAACTGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT

SEQ ID NO: 357 - protein, 141 aa, Artificial Sequence
  Synthetic: 28F3 (VH) (SEQ ID NO: 13) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS

SEQ ID NO: 358 - protein, 124 aa, Artificial Sequence
  Synthetic: 28F3 (VL) (SEQ ID NO: 14) with signal peptide
MRAWIFFLLCLAGRALAAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 359 - DNA, 423 bp, Artificial Sequence
  Synthetic: 28F3 (VH) with signal peptide nucleotide sequenceSEQ ID NO: 147 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctca

SEQ ID NO: 360 - DNA, 372 bp, Artificial Sequence
  Synthetic: 28F3 (VL) with signal peptide nucleotide sequenceSEQ ID NO: 148 with sequence encoding signal peptide
atgagggcttggatcttctttctgctctgcctggccgggcgcgccttggccgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 361 - protein, 470 aa, Artificial Sequence
  Synthetic: 28F3.IgG1 (VH + IgG1) (SEQ ID NO: 17) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 470 aa, Artificial Sequence
  Synthetic: 28F3.IgG1.1 (VH + IgG1.1) (SEQ ID NO: 18) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - DNA, 1413 bp, Artificial Sequence
  Synthetic: 28F3.IgG1 (VH + IgG1) with signal peptide nucleotide sequenceSEQ ID NO: 151 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 364 - DNA, 1413 bp, Artificial Sequence
  Synthetic: 28F3.IgG1.1 (VH + IgG1.1) with signal peptide nucleotide sequenceSEQ ID NO: 152 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 365 - protein, 231 aa, Artificial Sequence
  Synthetic: 28F3.IgG1 (VL+CL) (SEQ ID NO: 19) with signal peptide
MRAWIFFLLCLAGRALAAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - DNA, 696 bp, Artificial Sequence
  Synthetic: 28F3.IgG1 (VL+CL) with signal peptide nucleotide sequenceSEQ ID NO: 153 with signal sequence
atgagggcttggatcttctttctgctctgcctggccgggcgcgccttggccgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 367 - protein, 17 aa, Artificial Sequence
  Synthetic: Signal peptide
MRAWIFFLLCLAGRALA

SEQ ID NO: 368 - DNA, 51 bp, Artificial Sequence
  Synthetic: Signal peptide nucleotide sequence
atgagggcttggatcttctttctgctctgcctggccgggagagcgctcgca

SEQ ID NO: 369 - DNA, 51 bp, Artificial Sequence
  Synthetic: Signal peptide nucleotide sequence
atgagggcttggatcttctttctgctctgcctggccgggcgcgccttggcc

SEQ ID NO: 370 - protein, 31 aa, Homo sapiens
  misc_feature (1)..(31): Human GITR fragment
QRPTGGPGCGPGRLLLGTGTDARCCRVHTTR

SEQ ID NO: 371 - protein, 215 aa, Artificial Sequence; identical to SEQ ID NO: 104
  Synthetic: 9G7 L1 (full length wild-type light chain 1)

SEQ ID NO: 372 - protein, 5 aa, Artificial Sequence
  Synthetic: degenerate VH CDR1
  misc_feature (4)..(4): Xaa can be any naturally occurring amino acid
SYGXH

SEQ ID NO: 373 - protein, 17 aa, Artificial Sequence
  Synthetic: degenerate VH CDR2
  misc_feature (5)..(5): Xaa can be any naturally occurring amino acid
  misc_feature (10)..(10): Xaa can be any naturally occurring amino acid
VIWYXGSNKXYADSVKG

SEQ ID NO: 374 - protein, 17 aa, Artificial Sequence
  Synthetic: degenerate VH CDR2
  misc_feature (5)..(5): Xaa can be any naturally occurring amino acid
  misc_feature (10)..(10): Xaa can be any naturally occurring amino acid
  misc_feature (12)..(12): Xaa can be any naturally occurring amino acid
VIWYXGSNKXYXDSVKG

SEQ ID NO: 375 - protein, 15 aa, Artificial Sequence
  Synthetic: degenerate VH CDR3
  misc_feature (4)..(4): Xaa can be any naturally occurring amino acid
GGSXVRGDYYYGMDV

SEQ ID NO: 376 - protein, 15 aa, Artificial Sequence
  Synthetic: degenerate VH CDR3
  misc_feature (4)..(4): Xaa can be any naturally occurring amino acid
  misc_feature (8)..(8): Xaa can be any naturally occurring amino acid
GGSXVRGXYYYGMDV

SEQ ID NO: 377 - protein, 20 aa, Artificial Sequence
  Synthetic: degenerate VH CDR3
  misc_feature (3)..(8): Xaa can be any naturally occurring amino acid
  misc_feature (9)..(9): Xaa can be any naturally occurring amino acid and may or may not be present
  misc_feature (16)..(16): Xaa can be any naturally occurring amino acid
GGXXXXXXXMDVWYYXMDVW

SEQ ID NO: 378 - protein, 11 aa, Artificial Sequence
  Synthetic: degenerate VL CDR1
  misc_feature (9)..(9): Xaa can be any naturally occurring amino acid
RASQGISSXLA

SEQ ID NO: 379 - protein, 12 aa, Artificial Sequence
  Synthetic: degenerate VL CDR1
  misc_feature (6)..(6): Xaa can be any naturally occurring amino acid
  misc_feature (7)..(7): Xaa can be any naturally occurring amino acid and may or may not be present
  misc_feature (8)..(8): Xaa can be any naturally occurring amino acid
  misc_feature (10)..(10): Xaa can be any naturally occurring amino acid
RASQGXXXSXLA

SEQ ID NO: 380 - protein, 7 aa, Artificial Sequence
  Synthetic: degenerate VL CDR2
  misc_feature (6)..(6): Xaa can be any naturally occurring amino acid
DASSLXS

SEQ ID NO: 381 - protein, 9 aa, Artificial Sequence
  Synthetic: degenerate VL CDR3
  misc_feature (3)..(3): Xaa can be any naturally occurring amino acid
QQXNSYPYT

SEQ ID NO: 382 - protein, 9 aa, Artificial Sequence
  Synthetic: degenerate VL CDR3
  misc_feature (3)..(4): Xaa can be any naturally occurring amino acid
  misc_feature (6)..(6): Xaa can be any naturally occurring amino acid
  misc_feature (8)..(8): Xaa can be any naturally occurring amino acid
QQXXSXPXT

SEQ ID NO: 383 - protein, 123 aa, Artificial Sequence
  Synthetic: Heavy Chain Variable Region (VH) Amino Acid SequenceAnti-PD-L1 mAb (12A4; 12A4 in WO 2007/005874 and US Patent No. 7,943,743)
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 384 - DNA, 366 bp, Artificial Sequence
  Synthetic: Heavy Chain Variable Region (VH) Nucleotide SequenceAnti-PD-L1 mAb (12A4; 12A4 in WO 2007/005874 and US Patent No. 7,943,743)
caggtccagctggtgcagtctggggctgaggtgaagaagcctgggtcctcggtgaaggtctcctgcaagacttctggagacaccttcagcacctatgctatcagctgggtgcgacaggcccctggacaagggcttgagtggatgggagggatcatccctatatttggtaaagcacactacgcacagaagttccagggcagagtcacgattaccgcggacgaatccacgagcacagcctacatggagctgagcagcctgagatctgaggacacggccgtgtatttttgtgcgagaaagtttcactttgtttcggggagccccttcggtatggacgtctggggccaagggaccacggtcaccgtctcc

SEQ ID NO: 385 - protein, 106 aa, Artificial Sequence
  Synthetic: Light Chain Variable Region (VL) Amino Acid SequenceAnti-PD-L1 mAb (12A4; 12A4 in WO 2007/005874 and US Patent No. 7,943,743)
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 386 - DNA, 318 bp, Artificial Sequence
  Synthetic: Light Chain Variable Region (VL) Nucleotide SequenceAnti-PD-L1 mAb (12A4; 12A4 in WO 2007/005874 and US Patent No. 7,943,743)
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgacgttcggccaagggaccaaggtggaaatcaaa

SEQ ID NO: 387 - protein, 5 aa, Artificial Sequence
  Synthetic: Heavy Chain CDR1 Amino Acid Sequence  Anti-PD-L1 mAb (12A4; 12A4 in WO 2007/005874 and US Patent No. 7,943,743)
TYAIS

SEQ ID NO: 388 - protein, 16 aa, Artificial Sequence
  Synthetic: Heavy Chain CDR2 Amino Acid SequenceAnti-PD-L1 mAb (12A4; 12A4 in WO 2007/005874 and US Patent No. 7,943,743)
GIIPIFGKAHYAQKFQ

SEQ ID NO: 389 - protein, 14 aa, Artificial Sequence
  Synthetic: Heavy Chain CDR3 Amino Acid SequenceAnti-PD-L1 mAb (12A4; 12A4 in WO 2007/005874 and US Patent No. 7,943,743)
KFHFVSGSPFGMDV

SEQ ID NO: 390 - protein, 11 aa, Artificial Sequence
  Synthetic: Light Chain CDR1 Amino Acid SequenceAnti-PD-L1 mAb (12A4; 12A4 in WO 2007/005874 and US Patent No. 7,943,743)
RASQSVSSYLA

SEQ ID NO: 391 - protein, 7 aa, Artificial Sequence
  Synthetic: Light Chain CDR2 Amino Acid SequenceAnti-PD-L1 mAb (12A4; 12A4 in WO 2007/005874 and US Patent No. 7,943,743)
DASNRAT

SEQ ID NO: 392 - protein, 8 aa, Artificial Sequence
  Synthetic: Light Chain CDR3 Amino Acid SequenceAnti-PD-L1 mAb (12A4; 12A4 in WO 2007/005874 and US Patent No. 7,943,743)
QQRSNWPT

SEQ ID NO: 393 - protein, 440 aa, Artificial Sequence
  Synthetic: Heavy Chain Amino Acid SequenceAnti-PD-1 mAb (5C4 in WO 2006/121168)
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 394 - protein, 214 aa, Artificial Sequence
  Synthetic: Light Chain Amino Acid SequenceAnti-PD-1 mAb (5C4 in WO 2006/121168)
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - protein, 113 aa, Artificial Sequence [sequence omitted]

SEQ ID NO: 396 - DNA, 339 bp, Artificial Sequence
  Synthetic: Heavy Chain Variable Region (VH) Nucleotide SequenceAnti-PD-1 mAb (5C4 in WO 2006/121168) (SEQ ID NO:60 from WO 2006/121168)
caggtgcagctggtggagtctgggggaggcgtggtccagcctgggaggtccctgagactcgactgtaaagcgtctggaatcaccttcagtaactctggcatgcactgggtccgccaggctccaggcaaggggctggagtgggtggcagttatttggtatgatggaagtaaaagatactatgcagactccgtgaagggccgattcaccatctccagagacaattccaagaacacgctgtttctgcaaatgaacagcctgagagccgaggacacggctgtgtattactgtgcgacaaacgacgactactggggccagggaaccctggtcaccgtctcctca

SEQ ID NO: 397 - protein, 107 aa, Artificial Sequence [sequence omitted]

SEQ ID NO: 398 - DNA, 321 bp, Artificial Sequence
  Synthetic: Light Chain Variable Region (VL) Nucleotide SequenceAnti-PD-1 mAb (5C4 in WO 2006/121168) (SEQ ID NO:67 from WO 2006/121168)
gaaattgtgttgacacagtctccagccaccctgtctttgtctccaggggaaagagccaccctctcctgcagggccagtcagagtgttagtagttacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagtagcaactggcctcggacgttcggccaagggaccaaggtggaaatcaaa

SEQ ID NO: 399 - protein, 5 aa, Artificial Sequence
  Synthetic: Heavy Chain CDR1 Amino Acid Sequence  Anti-PD-1 mAb (5C4 in WO 2006/121168)  (SEQ ID NO:18 from WO 2006/121168)
NSGMH

SEQ ID NO: 400 - protein, 17 aa, Artificial Sequence
  Synthetic: Heavy Chain CDR2 Amino Acid SequenceAnti-PD-1 mAb (5C4 in WO 2006/121168) (SEQ ID NO:25 from WO 2006/121168)
VIWYDGSKRYYADSVKG

SEQ ID NO: 401 - protein, 4 aa, Artificial Sequence
  Synthetic: Heavy Chain CDR3 Amino Acid SequenceAnti-PD-1 mAb (5C4 in WO 2006/121168) (SEQ ID NO:32 from WO 2006/121168)
NDDY

SEQ ID NO: 402 - protein, 11 aa, Artificial Sequence
  Synthetic: Light Chain CDR1 Amino Acid SequenceAnti-PD-1 mAb (5C4 in WO 2006/121168) (SEQ ID NO:39 from WO 2006/121168)
RASQSVSSYLA

SEQ ID NO: 403 - protein, 7 aa, Artificial Sequence
  Synthetic: Light Chain CDR2 Amino Acid SequenceAnti-PD-1 mAb (5C4 in WO 2006/121168) (SEQ ID NO:46 from WO 2006/121168)
DASNRAT

SEQ ID NO: 404 - protein, 9 aa, Artificial Sequence
  Synthetic: Light Chain CDR3 Amino Acid SequenceAnti-PD-1 mAb (5C4 in WO 2006/121168) (SEQ ID NO:53 from WO 2006/121168)
QQSSNWPRT

SEQ ID NO: 405 - DNA, 2106 bp, Homo sapiens
  misc_feature (1)..(2106): Complete PD-1 sequence (GenBank Accession No.: U64863)
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttcttcccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctcccacctttacacatgcccaggcagcacctcaggccctttgtggggcagggaagctgaggcagtaagcgggcaggcagagctggaggcctttcaggccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgcgtggcctatccactcctcacatccacacactgcacccccactcctggggcagggccaccagcatccaggcggccagcaggcacctgagtggctgggacaagggatcccccttccctgtggttctattatattataattataattaaatatgagagcatgct

SEQ ID NO: 406 - protein, 290 aa, Homo sapiens
  misc_feature (1)..(290): Human PD-L1 amino acid sequence - isoform a precursor
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 407 - protein, 176 aa, Homo sapiens
  misc_feature (1)..(176): Human PD-L1 amino acid sequence - isoform b precursor
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

The invention claimed is:

1. A method of treating a human subject having an advanced solid cancer, comprising
   (a) administering to the subject a combination regimen comprising (1) a GITR agonist agent, and (2) a PD-1 or PD-L1 antagonist agent, wherein the GITR agonist agent and the PD-1 or PD-L1 antagonist agent are administered on the same day and for at least one cycle, wherein each cycle comprises 4 administrations of the combination regimen,
   (b) measuring the level of (1) Ki67+CD8 cells; (2) Ki67+ and/or HLA-DR+memory T cells and/or (3) Ki67+NK cells in the circulating blood of the subject prior to, and within 3-10 days, after administration of a dose of the combination regimen; and
   (c) administering a second or subsequent dose of the combination regimen when the levels of (1) Ki67+CD8 cells; (2) Ki67+ and/or HLA-DR+memory T cells and/or (3) Ki67+NK cells, respectively, are at about their baseline level, wherein the baseline level is the level immediately prior to administration of a first or previous dose of the combination regimen.

2. A method of treating a human subject having an advanced solid cancer, comprising:
   (i) administering to the subject a combination regimen comprising (1) an anti-GITR agonist antibody which binds to human GITR, wherein the antibody comprises VH CDR1, CDR2, and CDR3 comprising the amino acid sequences set forth in SEQ ID NOs: 20, 21 and 22, respectively, and VL CDR1, CDR2, and CDR3 comprising the amino acid sequences set forth in SEQ ID NOs: 23, 24 and 25, and (2) an anti-PD-1 antagonist antibody,
   wherein the anti-GITR agonist antibody and the anti-PD-1 antagonist antibody are administered on the same day and for at least one 8-week cycle, wherein each cycle comprises 4 administrations of the combination regimen, wherein the anti-GITR agonist antibody is administered at a flat dose of 30-800 mg,
   wherein the combination regimen increases the level of one or more of the following cell populations in the peripheral blood of the subject by at least 1.5-fold higher relative to baseline: (a) Ki67+CD8 cells; (b) Ki67+ and/or HLA-DR+memory CD4+cells; (c) Ki67+ and/or HLA-DR+memory CD8 cells, and/or (d) Ki67+ NK cells,
   (ii) measuring the level of (a) Ki67+CD8 cells; (b) Ki67+ and/or HLA-DR+memory T cells and/or (c) Ki67+NK cells in the circulating blood of the subject prior to, and within 3-10 days, after administration of a dose of the combination regimen; and
   (iii) administering a second or subsequent dose of the combination regimen when the levels of (a) Ki67+CD8 cells; (b) Ki67+ and/or HLA-DR+memory T cells and/or (c) Ki67+NK cells, respectively, are at about their baseline level, wherein the baseline level corresponds to the level before a first dose or previous dose of the combination regimen.

3. The method of claim 2, wherein the combination regimen increases the level of one or more of the following cell populations in the peripheral blood of the subject: CD45+CD3+CD4-CD8+Ki67+cells, CD45+CD3+CD4+ CD8-CD197-CD45RA-Ki67+cells, CD45+CD3+ CD4+CD8-CD197-CD45RA-HLA-DR+cells, CD45+ CD3+CD4+CD8-CD197+CD45RA-Ki67+cells, CD45+CD3+CD4+CD8-CD197+CD45RA-HLA-DR+ cells, CD45+CD3+CD4-CD8+CD197-CD45RA-Ki67+cells, CD45+CD3+CD4-CD8+CD197-CD45RA-HLA-DR+cells; CD45+CD3+CD4-CD8+ CD197+CD45RA-Ki67+cells, and CD45+CD3+CD4-CD8+CD197+CD45RA-HLA-DR+cells.

4. The method of claim 2, wherein administration of a second or subsequent dose of the combination regimen occurs on a day when one or more of the following cell populations in the peripheral blood of the subject is at about its level immediately prior to administration of a first or previous dose of the combination regimen: (a) Ki67+CD8 cells; (b) Ki67+ and/or HLA-DR+memory CD4 and/or CD8 T cells; (c) Ki67+NK cells, (d) Ki67+CD8 effector memory T cells; (e) HLA-DR+CD8 effector memory T cells; (f) Ki67+CD8 central memory T cells; (g) HLA-DR+CD8 central memory T cells; (h) Ki67+CD4 effector memory T cells; (i) HLA-DR+CD4 effector memory T cells; (j) Ki67+ CD4 central memory T cells; (k) HLA-DR+CD4 central memory T cells, (l) Ki67+CD8 effector memory T cells; and (m) HLA-DR+CD8 effector memory T cells.

5. The method of claim 4, wherein administration of the second or subsequent dose of the combination regimen occurs on a day when the one or more cell populations that are increased are within 2 fold of their baseline level, wherein the baseline level is the level immediately prior to administration of a first or previous dose of the combination regimen.

6. The method of claim 2, wherein the combination regimen is administered to the subject every 2, 3 or 4 weeks, for at least one cycle, wherein each cycle comprises 4 administrations of the combination regimen.

7. The method of claim 6, wherein the anti-PD-1 antagonist antibody is administered at a flat dose of 30-800 mg, and the combination regimen is administered every 2, 3 or 4 weeks for at least one cycle, wherein each cycle comprises 4 administrations of the anti-GITR agonist antibody and 4 administrations of the anti-PD-1 antagonist antibody.

8. The method of claim 2, wherein the cancer is a tumor type comprising:
   (a) tumors expressing high levels of GITR;
   (b) tumors having high levels of GITR positive Treg and/or Teff cells;
   (c) tumors having high levels of GITR positive Treg cells; and/or
   (d) tumors which are PD-L1 positive.

9. The method of claim 2, wherein:
   (a) the cancer is not typically responsive to immunotherapy;
   (b) the subject has not been previously treated with an immuno-oncology agent;
   (c) the subject has progressed on or after prior cancer therapy; and/or
   (d) the subject had progressed on or after a previous immunotherapy.

10. The method of claim 2, wherein the cancer is lung cancer, squamous cell carcinoma of the head and neck (SCCHN), cervical cancer, melanoma, colon cancer, breast cancer, bladder cancer, ovarian cancer, hepatocellular carcinoma (HCC), nasopharyngeal cancer, or adenocarcinoma of the ampulla of Vater.

11. The method of claim 2, wherein the anti-PD-1 antagonist antibody comprises the VH CDR1, CDR2, CDR3 and VL CDR1, CDR2 and CDR3 of nivolumab.

12. The method of claim 2, wherein the anti-GITR agonist antibody comprises a heavy chain variable region comprising the amino acid sequence set forth in SEQ ID NO: 13 and a light chain variable region comprising the amino acid sequence set forth in SEQ ID NO: 14.

13. The method of claim 12, wherein the anti-GITR agonist antibody comprises an IgG heavy chain constant region.

14. The method of claim 2, wherein the anti-GITR agonist antibody comprises a heavy chain comprising the amino acid sequence set forth in SEQ ID NO: 17 and a light chain comprising the amino acid sequence set forth in SEQ ID NO: 19, wherein the anti-GITR agonist antibody is administered to the subject at a flat dose ranging from 30-800 mg every 2 weeks, and 240 mg of nivolumab is administered to the subject every 2 weeks on the same days as the anti-GITR agonist antibody, for at least 3 or 4 cycles, wherein each cycle comprises 4 administrations of the anti-GITR agonist antibody and 4 administrations of nivolumab.

15. The method of claim 2, wherein, after 8 days of treatment,
  (a) the number of proliferating NK cells in peripheral blood is at least 2 fold higher relative to the level prior to the first dose,
  (b) the number of proliferating CD8+ T cells, or a subset thereof, in peripheral blood is at least 1.5 fold higher relative to the level prior to the first dose,
  (c) the number of activated CD8+ T cells, or a subset thereof, in peripheral blood is at least 1.5 fold higher relative to the level prior to the first dose, and/or
  (d) the number of activated CD4+ T cells, or a subset thereof, in peripheral blood is at least 1.5 fold higher relative to the level prior to the first dose.

16. The method of claim 2, wherein the anti-GITR agonist antibody comprises a heavy chain comprising the amino acid sequence set forth in SEQ ID NO: 17 and a light chain comprising the amino acid sequence set forth in SEQ ID NO: 19.

17. The method of claim 2, wherein the anti-PD1 antagonist antibody comprises the VH and VL regions of nivolumab.

18. The method of claim 2, wherein the anti-PD1 antagonist antibody comprises the heavy and light chains of nivolumab.

19. The method of claim 1, wherein the cancer is lung cancer, squamous cell carcinoma of the head and neck (SCCHN), cervical cancer, melanoma, colon cancer, breast cancer, bladder cancer, ovarian cancer, hepatocellular carcinoma (HCC), nasopharyngeal cancer, or adenocarcinoma of the ampulla of Vater.

* * * * *

UNITED STATES PATENT AND TRADEMARK OFFICE
CERTIFICATE OF CORRECTION

Page 1 of 2

PATENT NO. : 11,685,787 B2
APPLICATION NO. : 16/612956
DATED : June 27, 2023
INVENTOR(S) : Suba Krishnan et al.

It is certified that error appears in the above-identified patent and that said Letters Patent is hereby corrected as shown below:

In the Claims

At Column 155, Claim number 2, Line number 32, delete "NOs: 23, 24 and 25, and (2) an anti-PD-1 antagonist" and insert --NOs: 23, 24 and 25, respectively, and (2) an anti-PD-1 antagonist--

At Column 155, Claim number 2, Line number 44, delete "Ki67+ and/or HLA-DR+memory CD8cells; (b) Ki67+" and insert --Ki67+ and/or HLA-DR+memory CD8 cells; (b) Ki67+--

At Column 155, Claim number 3, Line number 62, delete "CD45+CD3+CD4-CD8+Ki67+cells, CD45+CD3+CD4+" and insert --CD45+CD3+CD4-CD8+Ki67+ cells, CD45+CD3+CD4+--

At Column 155, Claim number 3, Line number 63, delete "CD8-CD197-CD45RA-Ki67+cells, CD45+CD3+" and insert --CD8-CD197-CD45RA-Ki67+ cells, CD45+CD3+--

At Column 155, Claim number 3, Line number 64, delete "CD4+CD8-CD197-CD45RA-HLA-DR+cells, CD45+" and insert --CD4+CD8-CD197-CD45RA-HLA-DR+ cells, CD45+--

At Column 155, Claim number 3, Line number 65, delete "CD3+CD4+CD8-CD197+CD45RA-Ki67+cells," and insert --CD3+CD4+CD8-CD197+CD45RA-Ki67+ cells,--

At Column 156, Claim number 3, Line number 1, delete "Ki67+cells, CD45+CD3+CD4-CD8+CD197-" and insert --Ki67+ cells, CD45+CD3+CD4-CD8+CD197- --

At Column 156, Claim number 3, Line number 2, delete "CD45RA-HLA-DR+cells; CD45+CD3+CD4-CD8+" and insert --CD45RA-HLA-DR+ cells; CD45+CD3+CD4-CD8+--

At Column 156, Claim number 3, Line number 3, delete "CD197 +CD45RA-Ki 67+cells, and CD45+CD3+CD4-" and insert --CD197 +CD45RA-Ki 67+ cells, and CD45+CD3+CD4- --

Signed and Sealed this
Twenty-third Day of July, 2024

Katherine Kelly Vidal
*Director of the United States Patent and Trademark Office*

At Column 156, Claim number 3, Line number 4, delete "CD8+CD197+CD45RA-HLA-DR+cells." and insert --CD8+CD197+CD45RA-HLA-DR+ cells.--